(12) United States Patent
Smider et al.

(10) Patent No.: US 10,101,333 B2
(45) Date of Patent: Oct. 16, 2018

(54) METHODS FOR AFFINITY MATURATION-BASED ANTIBODY OPTIMIZATION

(71) Applicant: Fabrus, Inc., San Diego, CA (US)

(72) Inventors: Vaughn Smider, San Diego, CA (US); Helen Hongyuan Mao, San Diego, CA (US)

(73) Assignee: Taurus Biosciences, Inc., San Diego, CA (US)

( * ) Notice: Subject to any disclaimer, the term of this patent is extended or adjusted under 35 U.S.C. 154(b) by 0 days.

(21) Appl. No.: 14/692,646

(22) Filed: Apr. 21, 2015

(65) Prior Publication Data

US 2016/0069894 A1    Mar. 10, 2016

Related U.S. Application Data

(63) Continuation of application No. 13/508,353, filed as application No. PCT/US2010/055489 on Nov. 4, 2010, now abandoned.

(60) Provisional application No. 61/280,618, filed on Nov. 4, 2009, provisional application No. 61/395,670, filed on May 13, 2010.

(51) Int. Cl.

| C40B 30/04 | (2006.01) |
| G01N 33/68 | (2006.01) |
| C07K 16/00 | (2006.01) |
| C07K 16/28 | (2006.01) |
| C07K 16/32 | (2006.01) |
| C12N 15/10 | (2006.01) |

(52) U.S. Cl.
CPC ......... *G01N 33/6845* (2013.01); *C07K 16/00* (2013.01); *C07K 16/28* (2013.01); *C07K 16/2863* (2013.01); *C07K 16/32* (2013.01); *C12N 15/1058* (2013.01); *C07K 2317/33* (2013.01); *C07K 2317/34* (2013.01); *C07K 2317/55* (2013.01); *C07K 2317/56* (2013.01); *C07K 2317/76* (2013.01); *C07K 2317/92* (2013.01); *C40B 30/04* (2013.01)

(58) Field of Classification Search
None
See application file for complete search history.

(56) References Cited

U.S. PATENT DOCUMENTS

| 5,545,142 A | 8/1996 | Stephens et al. |
| 6,248,516 B1 | 6/2001 | Winter et al. |

(Continued)

FOREIGN PATENT DOCUMENTS

| EP | 0368684 A1 | 5/1990 |
| WO | WO 1992/001047 A1 | 1/1992 |

(Continued)

OTHER PUBLICATIONS

Rajpal et al. (Jun. 6, 2005) Proceedings of the National Academy of Sciences USA vol. 102 pp. 8466 to 8471.*

(Continued)

*Primary Examiner* — Christian C Boesen
(74) *Attorney, Agent, or Firm* — Morrison & Foerster

(57) ABSTRACT

Provided herein is a rational method of affinity maturation to evolve the activity of an antibody or portion thereof based on the structure/affinity or activity relationship of an antibody. The resulting affinity matured antibodies exhibit improved or optimized binding affinity for a target antigen.

38 Claims, 6 Drawing Sheets

Specification includes a Sequence Listing.

(56) References Cited

U.S. PATENT DOCUMENTS

| | | | |
|---|---|---|---|
| 6,593,081 | B1 | 7/2003 | Griffiths et al. |
| 6,989,250 | B2 | 1/2006 | Soderlind et al. |
| 7,189,841 | B2 | 3/2007 | Lerner et al. |
| 7,670,809 | B2 | 3/2010 | Bouayadi et al. |
| 2002/0102613 | A1 | 8/2002 | Hoogenboom et al. |
| 2003/0022240 | A1 | 1/2003 | Luo et al. |
| 2003/0153038 | A1 | 8/2003 | Ohlin et al. |
| 2005/0079574 | A1 | 4/2005 | Bond |
| 2005/0119455 | A1 | 6/2005 | Fuh et al. |
| 2006/0234302 | A1 | 10/2006 | Hoet et al. |

FOREIGN PATENT DOCUMENTS

| | | | |
|---|---|---|---|
| WO | WO 1996/007754 | A1 | 3/1996 |
| WO | WO 1997/008320 | A1 | 3/1997 |
| WO | WO 2002/038756 | A1 | 5/2002 |
| WO | WO 2005/023993 | A2 | 3/2005 |
| WO | WO 2007/054816 | A2 | 5/2007 |
| WO | WO 2007/137616 | A1 | 12/2007 |
| WO | WO 2010/054007 | A1 | 5/2010 |
| WO | WO 2010/054010 | A1 | 5/2010 |

OTHER PUBLICATIONS

Akamatsu et al., "Construction of a human Ig combinatorial library from genomic V segments and synthetic CDR3 fragments," J. Immunol. 151(9):4651-4659 (1993).
Barbas et al., "Assembly of combinatorial antibody libraries on phage surfaces: the gene III site," Proc. Natl. Acad. Sci. U.S.A. 88(18):7978-7982 (1991).
Barbas et al., "In vitro evolution of a neutralizing human antibody to human immunodeficiency virus type 1 to enhance affinity and broaden strain cross-reactivity," Proc. Natl. Acad. Sci. U.S.A. 91(9):3809-3813 (1994).
Barbas et al., "Semisynthetic combinatorial antibody libraries: a chemical solution to the diversity problem," Proc. Natl. Acad. Sci. U.S.A. 89(10):4457-4461 (1992).
Behar, "Design of synthetic antibody libraries," Expert Opin. Biol. Ther. 7(5):763-779 (2007).
Burton et al., "A large array of human monoclonal antibodies to type 1 human immunodeficiency virus from combinatorial libraries of asymptomatic seropositive individuals," Proc. Natl. Acad. Sci. U.S.A. 88(22):10134-10137 (1991).
Clackson et al., "Making antibody fragments using phage display libraries," Nature 352(6336): 624-628 (1991).
Cumbers et al., "Generation and iterative affinity maturation of antibodies in vitro using hypermutating B-cell lines," Nat. Biotechnol. 20(11):1129-1134 (2002) (Epub Oct. 15, 2002).
Dubreuil et al., "Fine tuning of the specificity of an anti-progesterone antibody by first and second sphere residue engineering," J. Biol. Chem. 280(26):24880-24887 (2005) (Epub May 4, 2005).
Embleton et al., "In-cell PCR from mRNA: amplifying and linking the rearranged immunoglobulin heavy and light chain V-genes within single cells," Nucleic Acids Res. 20(15):3831-3837 (1992).
Fellouse et al., "Synthetic antibodies from a four-amino-acid code: a dominant role for tyrosine in antigen recognition," Proc. Natl. Acad. Sci. U.S.A. 101(34):12467-12472 (2004) (Epub Aug. 11, 2004).
Griffiths et al., "Human anti-self antibodies with high specificity from phage display libraries," EMBO J. 12(2): 725-734 (1993).
Griffiths et al., "Isolation of high affinity human antibodies directly from large synthetic repertoires," EMBO J. 13(14): 3245-3260 (1994).
Hawkins et al., "Selection of phage antibodies by binding affinity. Mimicking affinity maturation," J. Mol. Biol. 226(3):889-896 (1992).
Higuchi et al., "A general method of in vitro preparation and specific mutagenesis of DNA fragments: study of protein and DNA interactions," Nucleic Acids Res. 16(15):7351-7367 (1988).
Hoey et al., "DLL4 blockade inhibits tumor growth and reduces tumor-initiating cell frequency," Cell Stem Cell 5(2):168-177 (2009).
Hogrefe et al., "A bacteriophage lambda vector for the cloning and expression of immunoglobulin Fab fragments on the surface of filamentous phage," Gene 128(1):119-126 (1993).
Hoogenboom and Winter, "By-passing immunisation. Human antibodies from synthetic repertoires of germline VH gene segments rearranged in vitro," J. Mol. Biol. 227(2):381-388 (1992).
Hoogenboom et al., "Multi-subunit proteins on the surface of filamentous phage: methodologies for displaying antibody (Fab) heavy and light chains," Nucleic Acids Res. 19(15):4133-4137 (1991).
Hoogenboom, "Selecting and screening recombinant antibody libraries," Nat. Biotechnol. 23(9):1105-1116 (2005).
Huse et al., "Generation of a large combinatorial library of the immunoglobulin repertoire in phage lambda," Science 246(4935):1275-1281 (1989).
Jackson et al., "In vitro antibody maturation. Improvement of a high affinity, neutralizing antibody against IL-1 beta," J. Immunol. 154(7):3310-3319 (1995).
Jones et al., "Rapid PCR-cloning of full-length mouse immunoglobulin variable regions," Biotechnology (NY) 9(1):88-89 (1991).
Kegler-Ebo et al., "Codon cassette mutagenesis: a general method to insert or replace individual codons by using universal mutagenic cassettes," Nucleic Acids Res. 22(9):1593-1599 (1994).
Knappik et al., "Fully synthetic human combinatorial antibody libraries (HuCAL) based on modular consensus frameworks and CDRs randomized with trinucleotides," J. Mol. Biol. 296(1):57-86 (2000).
Love, "Making antibodies from scratch," Nat. Biotechnol. 28(11):1176-1178 (2010).
Mao et al., "Spatially addressed combinatorial protein libraries for recombinant antibody discovery and optimization," Nat. Biotechnol. 28(11):1195-1202 (2010) (Epub Oct. 24, 2010).
Marks et al., "By-passing immunization. Human antibodies from V-gene libraries displayed on phage," J. Mol. Biol. 222(3):581-597 (1991).
Marks et al., "By-passing immunsization: building high affinity human antibodies by chain shuffling," Biotechnology (NY) 10(7):779-783 (1992).
Matsuda et al., "Structure and physical map of 64 variable segments in the 3'0.8-megabase region of the human immunoglobulin heavy-chain locus," Nat. Genet. 3(1):88-94 (1993).
McCall et al., "Isolation and characterization of an anti-CD16 single-chain Fv fragment and construction of an anti-HER2/neu/anti-CD16 bispecific scFv that triggers CD16-dependent tumor cytolysis," Mol. Immunol. 36(7):433-445 (1999).
Mondon et al., "Human antibody libraries: a race to engineer and explore a larger diversity," Front. Biosci. 13:1117-1129 (2008).
Needleman and Wunsch, "A general method applicable to the search for similarities in the amino acid sequence of two proteins," J. Mol. Biol. 48(3):443-453 (1970).
Nissim et al., "Antibody fragments from a 'single pot' phage display library as immunochemical reagents," EMBO J. 13(3):692-698 (1994).
Orlandi et al., "Cloning immunoglobulin variable domains for expression by the polymerase chain reaction," Proc. Natl. Acad. Sci. U.S.A. 86(10):3833-3837 (1989).
Ørum et al., "Efficient method for constructing comprehensive murine Fab antibody libraries displayed on phage," Nucleic Acids Res. 21(19):4491-4498 (1993).
Pearson and Lipman, "Improved tools for biological sequence comparison," Proc. Natl. Acad. Sci. U.S.A. 85(8):2444-2448 (1988).
Persson et al., "A focused antibody library for improved hapten recognition," J. Mol. Biol. 357(2):607-620 (2006) (Epub Jan. 19, 2006).
Rosok et al., "Analysis of BR96 binding sites for antigen and anti-idiotype by codon-based scanning mutagenesis," J. Immunol. 160(5):2353-2359 (1998).

(56) References Cited

OTHER PUBLICATIONS

Rothe et al., "The human combinatorial antibody library HuCAL GOLD combines diversification of all six CDRs according to the natural immune system with a novel display method for efficient selection of high-affinity antibodies," J. Mol. Biol. 376(4):1182-1200 (2008) (Epub Dec. 15, 2007).

Sastry et al., "Cloning of the immunological repertoire in *Escherichia coli* for generation of monoclonal catalytic antibodies: construction of a heavy chain variable region-specific cDNA library," Proc. Natl. Acad. Sci. U.S.A. 86(15):5728-5732 (1989).

Schier et al., "Isolation of picomolar affinity anti-c-erbB-2 single-chain Fv by molecular evolution of the complementarity determining regions in the center of the antibody binding site," J. Mol. Biol. 263(4):551-567 (1996).

Smith and Waterman, "Comparison of Biosequences," Adv. Appl. Math. 2:482-489 (1981).

Smith, "Filamentous fusion phage: novel expression vectors that display cloned antigens on the virion surface," Science 228(4705):1315-1317 (1985).

Tomlinson et al., "The repertoire of human germline VH sequences reveals about fifty groups of VH segments with different hypervariable loops," J. Mol. Biol. 227(3):776-798 (1992).

Ward et al., "Binding activities of a repertoire of single immunoglobulin variable domains secreted from *Escherichia coli*," Nature 341(6242):544-546 (1989).

Waterhouse et al., "Combinatorial infection and in vivo recombination: a strategy for making large phage antibody repertoires," Nucleic Acids Res. 21(9):2265-2266 (1993).

Williams and Winter, "Cloning and sequencing of human immunoglobulin V lambda gene segments," Eur. J. Immunol. 23(7):1456-1461 (1993).

Winter et al., "Making antibodies by phage display technology," Annu. Rev. Immunol. 12:433-455 (1994).

Wu et al., "Stepwise in vitro affinity maturation of Vitaxin, an alphav beta3-specific humanized mAb," Proc. Natl. Acad. Sci. U.S.A. 95(11):6037-6042 (1998).

Zhou et al., "Random mutagenesis of gene-sized DNA molecules by use of PCR with Taq DNA polymerase," Nucleic Acids Res. 19(21):6052 (1991).

* cited by examiner

```
┌─────────────────────────────────────┐
│     Select antibody as scaffold     │
└─────────────────────────────────────┘
                  ↓
┌─────────────────────────────────────┐
│   Identify sequence related antibody│
└─────────────────────────────────────┘
                  ↓
  →┌─────────────────────────────────────┐
   │  Compare VH or VL of related antibodies│
   └─────────────────────────────────────┘
                  ↓
   ┌─────────────────────────────────────┐
   │        Identify target region        │
   └─────────────────────────────────────┘
         ↓                    ↓
   ┌──────────────┐      ┌──────────────────┐
   │   Perform    │      │ Perform Mutagenesis│←
   │   Scanning   │      └──────────────────┘
   │ Mutagenesis  │              ↓
   └──────────────┘              │
         ↓                       │
   ┌──────────────┐              │
   │  Identify    │              │
   │  residues    │              │
   │ involved in  │              │
   │ an activity  │              │
   │   to target  │              │
   │   antigen    │              │
   └──────────────┘              │
         ↓                       │
   ┌──────────────┐              │
   │Mutate residues│             │
   │that do not   │              │
   │affect activity│             │
   │to target     │              │
   │antigen       │              │
   └──────────────┘              │
         ↓                       ↓
   ┌─────────────────────────────────────┐
   │ Identify mutations that increase     │
   │    activity to the target antigen    │
   └─────────────────────────────────────┘
                  ↓
   ┌─────────────────────────────────────┐
   │      Prepare Combination Mutants     │
   └─────────────────────────────────────┘
                  ↓
   ┌─────────────────────────────────────┐
   │   Determine Activity for target antigen│
   └─────────────────────────────────────┘
         ↓                       ↓
   ┌──────────────┐      ┌──────────────────┐
   │ Repeat for   │      │ Select additional │
   │ other        │      │ regions of        │
   │ variable     │      │ polypeptide for   │
   │ chain        │      │ further mutagenesis│
   └──────────────┘      └──────────────────┘
```

FIG. 1

```
                                                                                    CDRH1
VH1-46_IGHD6-6*01_IGHJ1*01    QVQLVQSGAEVKKPGASVKVSCKASGYTFTSYYMHWVRQAPGQGLEWMGIINPSGGSTSY 60
VH1-46_IGHD6-13*01_IGHJ4*01   QVQLVQSGAEVKKPGASVKVSCKASGYTFTSYYMHWVRQAPGQGLEWMGIINPSGGSTSY 60
                              ************************************************************
                                                                                    CDRH2
                                                                            CDRH3
VH1-46_IGHD6-6*01_IGHJ1*01    AQKFQGRVTMTRDTSTSTVYMELSSLRSEDTAVYYCAREEYSSSSAEYFQHWGQGTLVTV 120
VH1-46_IGHD6-13*01_IGHJ4*01   AQKFQGRVTMTRDTSTSTVYMELSSLRSEDTAVYYCAREGYSSSWYDYFDYWGQGTLVTV 120
                              *************************************   *** *  **:*********

VH1-46_IGHD6-6*01_IGHJ1*01    SS 122
VH1-46_IGHD6-13*01_IGHJ4*01   SS 122
                              **
```

FIG. 2A

```
                                                             CDRL1                              CDRL2
L6_IGKJ1*01    EIVLTQSPATLSLSPGERATLSCRASQSVSSY-LAWYQQKPGQAPRLLIYDASNRATGIP 59
A27_IGKJ1*01   EIVLTQSPGTLSLSPGERATLSCRASQSVSSYLAWYQQKPGQAPRLLIYGASSRATGIP 60
L25_IGKJ1*01   EIVMTQSPATLSLSPGERATLSCRASQSVSSYLLSWYQQKPGQAPRLLIYGASTRATGIP 60
L2_IGKJ1*01    EIVMTQSPATLSVSPGERATLSCRASQSVSSN-LAWYQQKPGQAPRLLIYGASTRATGIP 59
               ***:****.***:********************  :*****************.*:******
                                                                      CDRL3
L6_IGKJ1*01    ARFSGSGSGTDFTLTISSLEPEDFAVYYCQQRSNWPPWTFGQGTKVEIK 108
A27_IGKJ1*01   DRFSGSGSGTDFTLTISRLEPEDFAVYYCQQYGSSPPWTFGQGTKVEIK 109
L25_IGKJ1*01   ARFSGSGSGTDFTLTISSLQPEDFAVYYCQQDYNLPPWTFGQGTKVEIK 109
L2_IGKJ1*01    ARFSGSGSGTEFTLTISSLQSEDFAVYYCQQYNNWPPWTFGQGTKVEIK 108
               **********:******  *: **********   :************
```

FIG. 2B

```
                                              CDRH1                                                CDRH2
VH5-51_IGHD5-18*01>3_IGHJ4*01    EVQLVQSGAEVKKPGESLKISCKGSGYSFTSYWIGWVRQMPGKGLEWMGIIYPGDSDTRY 60
VH5-51_IGHD6-25*01_IGHJ4*01      EVQLVQSGAEVKKPGESLKISCKGSGYSFTSYWIGWVRQMPGKGLEWMGIIYPGDSDTRY 60
                                 ************************************************************
                                                              CDRH3
VH5-51_IGHD5-18*01>3_IGHJ4*01    SPSFQGQVTISADKSISTAYLQWSSLKASDTAMYYCARRGYSYGYDYFDYWGQGTLVTVS 120
VH5-51_IGHD6-25*01_IGHJ4*01      SPSFQGQVTISADKSISTAYLQWSSLKASDTAMYYCARQGYSSGYDYFDYWGQGTLVTVS 120
                                 *************************************:***.*****************

VH5-51_IGHD5-18*01>3_IGHJ4*01    S 121
VH5-51_IGHD6-25*01_IGHJ4*01      S 121
                                 *
```

FIG. 3

```
VH1-46_IGHD6-6*01_IGHJ1*01   QVQLVQSGAEVKKPGASVKVSCKASGYTFTSYYMHWVRQAPGQGLEWMGIINPSGGSTSY 60
VH1-46_IGHD6-6*01_IGHJ2*01   QVQLVQSGAEVKKPGASVKVSCKASGYTFTSYYMHWVRQAPGQGLEWMGIINPSGGSTSY 60
VH1-46_IGHD6-6*01_IGHJ4*01   QVQLVQSGAEVKKPGASVKVSCKASGYTFTSYYMHWVRQAPGQGLEWMGIINPSGGSTSY 60
VH1-46_IGHD6-6*01_IGHJ5*01   QVQLVQSGAEVKKPGASVKVSCKASGYTFTSYYMHWVRQAPGQGLEWMGIINPSGGSTSY 60
                             ************************************************************

CDRH3
VH1-46_IGHD6-6*01_IGHJ1*01   AQKFQGRVTMTRDTSTSTVYMELSSLRSEDTAVYYCAREEYSSSSAEYFQHWGQGTLVTV 120
VH1-46_IGHD6-6*01_IGHJ2*01   AQKFQGRVTMTRDTSTSTVYMELSSLRSEDTAVYYCAREEYSSSSYWFDLWGRGTLVTV 120
VH1-46_IGHD6-6*01_IGHJ4*01   AQKFQGRVTMTRDTSTSTVYMELSSLRSEDTAVYYCAREEYSSSSD-YFDYWGQGTLVTV 119
VH1-46_IGHD6-6*01_IGHJ5*01   AQKFQGRVTMTRDTSTSTVYMELSSLRSEDTAVYYCAREEYSSSSDNYFDYWGQGTLVTV 120
                             ***********************************:********      :.*******

VH1-46_IGHD6-6*01_IGHJ1*01   SS 122
VH1-46_IGHD6-6*01_IGHJ2*01   SS 122
VH1-46_IGHD6-6*01_IGHJ4*01   SS 121
VH1-46_IGHD6-6*01_IGHJ5*01   SS 122
                             **

FIG. 4A

VH5-51_IGHD5-18*01>3_IGHJ1*01   EVQLVQSGAEVKKPGESLKISCKGSGYSFTSYWIGWVRQMPGKGLEWMGIIYPGDSDTRY 60
VH5-51_IGHD5-18*01>3_IGHJ3*01   EVQLVQSGAEVKKPGESLKISCKGSGYSFTSYWIGWVRQMPGKGLEWMGIIYPGDSDTRY 60
VH5-51_IGHD5-18*01>3_IGHJ4*01   EVQLVQSGAEVKKPGESLKISCKGSGYSFTSYWIGWVRQMPGKGLEWMGIIYPGDSDTRY 60
VH5-51_IGHD5-18*01>3_IGHJ5*01   EVQLVQSGAEVKKPGESLKISCKGSGYSFTSYWIGWVRQMPGKGLEWMGIIYPGDSDTRY 60
                                ************************************************************

CDRH3
VH5-51_IGHD5-18*01>3_IGHJ1*01   SPSFQGQVTISADKSISTAYLQWSSLKASDTAMYYCARRGYSYGYAEYFQHWGQGTLVTV 120
VH5-51_IGHD5-18*01>3_IGHJ3*01   SPSFQGQVTISADKSISTAYLQWSSLKASDTAMYYCARRGYSYGYD-AFDVWGQGTLVTV 119
VH5-51_IGHD5-18*01>3_IGHJ4*01   SPSFQGQVTISADKSISTAYLQWSSLKASDTAMYYCARRGYSYGYD-YFDYWGQGTLVTV 119
VH5-51_IGHD5-18*01>3_IGHJ5*01   SPSFQGQVTISADKSISTAYLQWSSLKASDTAMYYCARRGYSYGYDNWFDSWGQGTLVTV 120
                                **************************************:******      ..*******

VH5-51_IGHD5-18*01>3_IGHJ1*01   SS 122
VH5-51_IGHD5-18*01>3_IGHJ3*01   SS 121
VH5-51_IGHD5-18*01>3_IGHJ4*01   SS 121
VH5-51_IGHD5-18*01>3_IGHJ5*01   SS 122
                                **

FIG. 4B
```

```
VH5-51_IGHD5-18*01>3_IGHJ4*01    EVQLVQSGAEVKKPGESLKISCKGSGYSFTSYWIGWVRQMPGKGLEWMGIIYPGDSDTRY 60
VH5-51_IGHD5-12*01_IGHJ4*01      EVQLVQSGAEVKKPGESLKISCKGSGYSFTSYWIGWVRQMPGKGLEWMGIIYPGDSDTRY 60
VH5-51_IGHD5-24*01_IGHJ4*01      EVQLVQSGAEVKKPGESLKISCKGSGYSFTSYWIGWVRQMPGKGLEWMGIIYPGDSDTRY 60
                                 ************************************************************

CDRH3
VH5-51_IGHD5-18*01>3_IGHJ4*01    SPSFQGQVTISADKSISTAYLQWSSLKASDTAMYYCARRGYS-MGYDYFDYWGQGTLVTV 119
VH5-51_IGHD5-12*01_IGHJ4*01      SPSFQGQVTISADKSISTAYLQWSSLKASDTAMYYCARRGYSGYDYDYFDYWGQGTLVTV 120
VH5-51_IGHD5-24*01_IGHJ4*01      SPSFQGQVTISADKSISTAYLQWSSLKASDTAMYYCARRRDG-VNYDYFDYWGQGTLVTV 119
                                 ******************************************  * **************

VH5-51_IGHD5-18*01>3_IGHJ4*01    SS 121
VH5-51_IGHD5-12*01_IGHJ4*01      SS 122
VH5-51_IGHD5-24*01_IGHJ4*01      SS 121
                                 **
```

FIG. 4C

|  | CDRH1 | CDRH2 | |
|---|---|---|---|
| VH3-23_IGHD2-2*01>3_IGHJ6*01 | EVQLLESGGGLVQPGGSLRLRLSCAASGFTFSSYAMSWVRQAPGKGLEWVSSISGSGGSTYY | 60 |
| VH3-23_IGHD2-8*01>3_IGHJ6*01 | EVQLLESGGGLVQPGGSLRLRLSCAASGFTFSSYAMSWVRQAPGKGLEWVSSISGSGGSTYY | 60 |
| VH3-23_IGHD2-15*01>3_IGHJ6*01 | EVQLLESGGGLVQPGGSLRLRLSCAASGFTFSSYAMSWVRQAPGKGLEWVSSISGSGGSTYY | 60 |
| **VH3-23_IGHD2-21*01>3_IGHJ6*01** | EVQLLESGGGLVQPGGSLRLRLSCAASGFTFSSYAMSWVRQAPGKGLEWVSSISGSGGSTYY | 60 |
|  | ************************************************************ |  |

|  | CDRH3 |  |
|---|---|---|
| VH3-23_IGHD2-2*01>3_IGHJ6*01 | ADSVKGRFTISRDNSKNTLYLQMNSLRAEDTAVYYCAKEDIVVVPAAMSYYYYYYGMDVW | 120 |
| VH3-23_IGHD2-8*01>3_IGHJ6*01 | ADSVKGRFTISRDNSKNTLYLQMNSLRAEDTAVYYCAKEDIVLMVYAISYYYYYYGMDVW | 120 |
| VH3-23_IGHD2-15*01>3_IGHJ6*01 | ADSVKGRFTISRDNSKNTLYLQMNSLRAEDTAVYYCAKEDIVVVAATSYYYYYYGMDVW | 120 |
| **VH3-23_IGHD2-21*01>3_IGHJ6*01** | ADSVKGRFTISRDNSKNTLYLQMNSLRAEDTAVYYCAKEHIVVV-IAISYYYYYYGMDVW | 119 |
|  | ****************************************:.*.**.:: * *********** |  |

| VH3-23_IGHD2-2*01>3_IGHJ6*01 | GQGTLVTVSSAS | 132 |
| VH3-23_IGHD2-8*01>3_IGHJ6*01 | GQGTLVTVSSAS | 132 |
| VH3-23_IGHD2-15*01>3_IGHJ6*01 | GQGTLVTVSSAS | 132 |
| **VH3-23_IGHD2-21*01>3_IGHJ6*01** | GQGTLVTVSSAS | 131 |
|  | ************ |  |

FIG. 5

METHODS FOR AFFINITY MATURATION-BASED ANTIBODY OPTIMIZATION

RELATED APPLICATIONS

This application is a continuation of U.S. application Ser. No. 13/508,353, filed May 4, 2012, which is a U.S. National Stage Application under 35 U.S.C. § 371 of International Patent Application No. PCT/US2010/055489, filed Nov. 4, 2010, which claims the benefit of priority to U.S. Provisional Application Ser. No. 61/280,618, entitled "Methods for Affinity Maturation-Based Antibody Optimization," filed Nov. 4, 2009, and to U.S. Provisional Application Ser. No. 61/395,670, entitled "Methods for Affinity Maturation-Based Antibody Optimization, Antibody Conversion and Antibodies," filed May 13, 2010, the entire contents of which are each incorporated herein by reference.

This application also is related to International PCT Application No. PCT/US2009/063299, entitled "Combinatorial Antibody Libraries and Uses Thereof," filed Nov. 4, 2009, which claims priority to U.S. Provisional Application No. 61/198,764 filed Nov. 7, 2008 and to U.S. Provisional Application No. 61/211,204 filed Mar. 25, 2009, each entitled "Combinatorial Antibody Libraries and Uses Thereof." This application also is related to International PCT Application No. PCT/US09/63303, entitled Anti-DLL4 Antibodies and Uses Thereof, which also claims priority to each of U.S. Provisional Application Nos. 61/198,764 and 61/211,204.

The subject matter of each of the above-noted applications is incorporated by reference in its entirety.

SEQUENCE LISTING

The instant application contains a Sequence Listing which has been submitted in ASCII format via EFS-Web and is hereby incorporated by reference in its entirety. Said ASCII copy, created on Apr. 21, 2015, is named 13379-017-999_Sequence_Listing.txt and is 3,157,176 bytes in size.

FIELD OF THE INVENTION

Provided herein is a rational method of affinity maturation to evolve the activity of an antibody or portion thereof based on the structure/affinity or activity relationship of an antibody. The resulting affinity matured antibodies exhibit improved or optimized binding affinity for a target antigen.

BACKGROUND

Numerous therapeutic and diagnostic monoclonal antibodies (MAbs) are used in the clinical setting to treat and diagnose human diseases, for example, cancer and autoimmune diseases. For example, exemplary therapeutic antibodies include Rituxan (Rituximab), Herceptin (Trastuzumab), Avastin (Bevacizumab) and Remicade (Infliximab). In designing antibody therapeutics, it is desirable to create antibodies, for example, antibodies that modulate a functional activity of a target, and/or improved antibodies such as antibodies with higher specificity and/or affinity and/or and antibodies that are more bioavailable, or stable or soluble in particular cellular or tissue environments. It is among the objects herein to provide methods for optimizing and improving the binding affiniites of antibodies and for selecting antibodies with desired affinities.

SUMMARY

Provided herein are methods of affinity maturation of antibodies or fragments thereof based on structure/activity relationship (SAR). The methods result in the optimization of antibodies to have increased and improved activity (e.g. binding specificity or affinity) for a target antigen compared to the starting antibody that is affinity matured.

Provided herein is a method of affinity maturation of a first antibody or portion thereof for a target antigen. In the method, a related antibody or portion thereof is identified that exhibits a reduced activity for the target antigen than the corresponding form of a first antibody, whereby the related antibody or portion thereof contains a related variable heavy chain or a related variable light chain that is either 1) one in which the corresponding variable heavy chain or variable light chain of the related antibody exhibits at least 75% amino acid sequence identity to the variable heavy chain or variable light chain of the first antibody but does not exhibit 100% sequence identity therewith; or 2) one in which at least one of the $V_H$, $D_H$ and $J_H$ germline segments of the nucleic acid molecule encoding the variable heavy chain of the related antibody is identical to one of the $V_H$, $D_H$ and $J_H$ germline segments of the nucleic acid molecule encoding the variable heavy chain of the first antibody and/or at least one of the $V_\kappa$ and $J_\kappa$ or at least one of the $V_\lambda$, and $J_\lambda$, germline segments of the nucleic acid molecule encoding the variable light chain is identical to one of the $V_\kappa$ and $J_\kappa$ or $V_\lambda$, and $J_\lambda$, germline segments of the nucleic acid molecule encoding the variable light chain of the first antibody. Further, in the method, the amino acid sequence of the variable heavy chain or variable light chain of the first antibody is compared to the amino acid sequence of the corresponding related variable heavy chain or variable light chain of the related antibody. Following comparison, a target region within the variable heavy chain or variable light chain of a first antibody is identified, whereby a target region is a region in the first antibody that exhibits at least one amino acid difference compared to the same region in the related antibody. After identifying a target region, a plurality of modified antibodies are produced each containing a variable heavy chain and a variable light chain, or a portion thereof, where at least one of the variable heavy chain or variable light chain is modified in its target region by replacement of a single amino acid residue, such that the target region in each of the plurality of antibodies contains replacement of an amino acid to a different amino acid compared to the first antibody. The resulting plurality of mutated antibodies are screened for an activity to the target antigen. Modified antibodies that exhibit increased activity for the target antigen compared to the first antibody. In one example of the method, the plurality of modified antibodies are produced by producing a plurality of nucleic acid molecules that encode modified forms of a variable heavy chain or a variable light chain of the first antibody, wherein the nucleic acid molecules contain one codon encoding an amino acid in the target region that encodes a different amino acid from the unmodified variable heavy or variable light chain, such that each nucleic acid molecule of the plurality encodes a variable heavy chain or variable light chain that is modified in its target region by replacement of a single amino acid residue.

In the method provided herein, the target region in the first antibody exhibits 1, 2, 3, 4, 5, 6 7, 8, 9 or 10 amino acid differences compared to the corresponding region in the related antibody. Further, in the method, the first antibody can be compared to 1, 2, 3, 4, or 5 related antibodies. In the method herein, the target region is selected from among a CDR1, CDR2, CDR3, FR1, FR2, FR3 and FR4. For example, the target region is a CDR1, CDR2 or CDR3.

In the method provided herein, an activity that is assessed can be binding, signal transduction, differentiation, alteration of gene expression, cellular proliferation, apoptosis, chemotaxis, cytotoxicity, cancer cell invasion, endothelial cell proliferation or tube formation. In one example, the activity is binding and binding is assessed by an immunoassay, whole cell panning or surface plasmon resonance (SPR). For example, binding can be assessed by immunoassay such as by a radioimmunoassay, enzyme linked immunosorbent assay (ELISA) or electrochemiluminescence assay. In particular, binding is assessed using an electrochemiluminescence assay such as meso scale discovery (MSD).

In the method herein, the first antibody that is affinity matured binds to the target antigen with a binding affinity that is at or about $10^{-4}$ M, $10^{-5}$ M, $10^{-6}$ M, $10^{-7}$ M, $10^{-8}$ M, or lower, when the antibody is in a Fab form.

In one example, the affinity maturation method provided herein involves comparison to a related antibody or portion thereof that exhibits 80%, 70%, 60%, 50%, 40%, 30%, 20%, 10%, 5% or less activity than the corresponding form of the first antibody. For example, the related antibody can exhibit the same or similar level of activity to the target antigen compared to a negative control. In another example, the related antibody exhibits a binding affinity that is less than the binding affinity of the first antibody, whereby the binding affinity is at or about $10^{-4}$ M, $10^{-5}$ M, $10^{-6}$ M, $10^{-7}$ M, $10^{-8}$ M or lower in its Fab form. In one example of the method provided herein, a target region is identified within the variable heavy chain of the first antibody, and the method is performed therefrom. In another example of a method provided herein, a target region is identified within the variable light chain of the first antibody, the method is performed therefrom. In a further example of the method herein, a target region is identified within the variable heavy chain of the first antibody and steps the method is performed therefrom; and separately and independently a target region is identified within the variable light chain of the first antibody, and the method is performed therefrom.

In one aspect of the method herein, a related antibody that contains the related corresponding variable heavy chain is different than a related antibody that contains the related corresponding variable light chain. In another aspect of the method herein, a related antibody that contains the related corresponding variable heavy chain is the same as a related antibody that contains the related corresponding variable light chain.

In one example of the method herein, the variable heavy chain or variable light chain of the first antibody exhibits 80%, 85%, 90%, 91%, 92%, 93%, 94%, 95%, 96%, 97%, 98% or 99% sequence identity with the corresponding related variable heavy chain or variable light chain of the related antibody. In particular, the variable heavy chain or variable light chain of the first antibody exhibits at least 95% sequence identity with the corresponding related variable heavy chain or variable light chain of the related antibody.

In another example, the related antibody contains a related variable heavy chain or variable light chain that is one in which at least one of the $V_H$, $D_H$ and $J_H$ germline segments of the nucleic acid molecule encoding the variable heavy chain of the first antibody is identical to one of the $V_H$, $D_H$ and $J_H$ germline segments of the nucleic acid molecule encoding the variable heavy chain of the related antibody; and/or at least one of the $V_\kappa$ and $J_\kappa$ or at least one of the $V_\lambda$, and $J_\lambda$, germline segments of the nucleic acid molecule encoding the variable light chain of the first antibody is identical to one of the $V_\kappa$ and $J_\kappa$ or $V_\lambda$, and $J_\lambda$, germline segments of the nucleic acid molecule encoding the variable light chain of the related antibody. For example, the related antibody contains a related variable heavy chain or variable light that is one in which at least one of the $V_H$, $D_H$ and $J_H$ germline segments of the nucleic acid molecule encoding the variable heavy chain of the first antibody is from the same gene family as one of the $V_H$, $D_H$ and $J_H$ germline segments of the nucleic acid molecule encoding the variable heavy chain of the related antibody; and/or at least one of the $V_\kappa$ and $J_\kappa$ or at least one of the $V_\lambda$, and $J_\lambda$, germline segments of the nucleic acid molecule encoding the variable light chain of the first antibody is from the same gene family as one of the $V_\kappa$ and $J_\kappa$ or $V_\lambda$, and $J_\lambda$, germline segments of the nucleic acid molecule encoding the variable light chain of the related antibody. In such examples, the variable heavy chain or variable light chain of the first antibody exhibits 60%, 70%, 80%, 85%, 90%, 91%, 92%, 93%, 94%, 95%, 96%, 97%, 98% or 99% sequence identity with the corresponding related variable heavy chain or variable light chain of the related antibody.

In the method herein, the first antibody is identified by screening a combinatorial antibody library, where the combinatorial antibody library is produced by combining a $V_H$, a $D_H$ and a $J_H$ human germline segment or portion thereof in frame to generate a sequence of a nucleic acid molecule encoding a VH chain or a portion thereof; and combining a $V_\kappa$ and a $J_\kappa$ human germline segment or portion thereof, or a $V_\lambda$ and a $J_\lambda$ germline segment or portion thereof in frame to generate a sequence of a nucleic acid molecule encoding a VL chain or a portion thereof. In the steps of combining, each of the portions of the $V_H$, $D_H$, $J_H$, $V_\kappa$, $J_\kappa$, $V_\lambda$, or $J_\lambda$, are sufficient to produce an antibody or portion thereof containing a VH or VL or portion thereof that forms a sufficient antigen binding site. The steps of combining are repeated a plurality of times to generate sequences of a plurality of different nucleic acid molecules. The nucleic acid molecules are synthesized to produce two libraries. The first library contains nucleic acid molecules encoding a VH chain or a portion thereof; and the second library contains nucleic acid molecules encoding a VL chain or a portion thereof. The nucleic acid molecules from the first and second library are introduced into a cell, which is repeated a plurality of times to produce a library of cells, wherein each cell contains nucleic acid molecules encoding a different combination of VH and VL from every other cell in the library of cells. Finally, in the method of generating a combinatorial library, the cells are grown to express the antibodies or portions thereof in each cell, thereby producing a plurality of antibodies or portion thereof, wherein each antibody or portion thereof in the library comprises a different combination of a VH and a VL chain or a sufficient portion thereof to form an antigen binding site from all other antibodies or portions thereof in the library. To identify a first antibody, the library is screened by contacting an antibody or portion thereof in the library with a target protein, assessing binding of the antibody or portion thereof with the target protein and/or whether the antibody or portion thereof modulates a functional activity of the target protein; and identifying an antibody or portion thereof that exhibits an activity for the target protein, wherein the identified antibody or portion thereof is a first antibody. Similarly, a related antibody also can be identified by screening such a combinatorial antibody library for the target antigen to identify a related antibody that exhibits reduced activity for the target antigen compared to the first antibody.

The combinatorial library that is screened can be an addressable library. In an addressable library, the synthesized nucleic acid sequences are individually addressed, thereby generating a first addressed nucleic acid library and a second addressed nucleic acid library. The cells also are addressed such that each locus contains a cell that contains nucleic acid molecules encoding a different combination of a VH and a VL from every other cell in the addressed library of cells. Finally, the plurality of antibodies or portions thereof are addressed, such that the antibodies or portions thereof at each locus in the library are the same antibody and are different from those at each and every other locus; and the identity of the antibody or portion thereof is known by its address. The addressable library can be arranged in a spatial array, wherein each individual locus of the array corresponds to a different antibody member. The spatial array can be a multiwell plate. In another example, the antibodies in the addressable library can be attached to a solid support that is a filter, chip, slide, bead or cellulose, and the different antibody members are immobilized to the surface thereof.

In the affinity maturation method herein, the target antigen is a polypeptide, carbohydrate, lipid, nucleic acid or a small molecule. The target antigen can expressed on the surface of a virus, bacteria, tumor or other cell, or is a recombinant protein or peptide. In one example, the target antigen is a protein that is a target for therapeutic intervention. For example, the target antigen is involved in cell proliferation and differentiation, cell migration, apoptosis or angiogenesis. Exemplary of target antigens include, but are not limited to, a VEGFR-1, VEGFR-2, VEGFR-3 (vascular endothelial growth factor receptors 1, 2, and 3), a epidermal growth factor receptor (EGFR), ErbB-2, ErbB-3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d' origine nantais; also known as macrophage stimulating 1 receptor), TEK (endothelial-specific receptor tyrosine kinase), TIE (tyrosine kinase with immunoglobulin and epidermal growth factor homology domains receptor), CSF1R (colony stimulating factor 1 receptor), PDGFRB (platelet-derived growth factor receptor B), EPHA1, EPHA2, EPHB 1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R, EPO-R., a cadherin, an integrin, CD52, CD44, VEGF-A, VEGF-B, VEGF-C, VEGF-D, PIGF, EGF, HGF, TNF-α, LIGHT, BTLA, lymphotoxin (LT), IgE, G-CSF, GM-CSF and EPO.

In the affinity maturation method provided herein, a subset of the amino acid residues in the target region are modified by amino acid replacement. In one example, only the amino acid residues that differ between the first antibody and related antibody in the target region are modified by amino acid replacement. In another example, only the amino acid residues that are the same between the first antibody and the related antibody in the target region are modified by amino acid replacement. In some instances in the method provided herein, all of the amino acids residues in the target region are modified by amino acid replacement. For amino acid that is modified, the amino acid replacement can be to all 19 other amino acid residues, or a restricted subset thereof.

In the method provided herein, that antibody is mutated by PCR mutagenesis, cassette mutagenesis, site-directed mutagenesis, random point mutagenesis, mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient host strains, restriction-selection and restriction-purification, deletion mutagenesis, mutagenesis by total gene synthesis, and double-strand break repair. The antibody can be mutated by NNK, NNS, NNN, NNY or NNR mutagenesis.

In one aspect of the method, scanning mutagenesis of the target region is performed to further elucidate amino acid residues to mutagenenize. In such a method, scanning mutagenesis is performed on the first antibody by producing a plurality of modified antibodies comprising a variable heavy chain and a variable light chain, or a portion thereof, where at least one of the variable heavy chain or variable light chain is one that is modified by replacement of a single amino acid residue with another amino acid residue in the target region, whereby each of the plurality of antibodies contains replacement of an amino acid in the target region compared to the first antibody. Each of the plurality of modified antibodies are screened for an activity to the target antigen. A second antibody is selected from among the modified antibodies that exhibits retained or increased activity for the target antigen compared to the first antibody not containing the amino acid replacement, whereby the second antibody is used in place of the first antibody in the affinity maturation method herein above. In such an example, the plurality of modified antibodies can be produced by producing a plurality of nucleic acid molecules that encode modified forms of a variable heavy chain or a variable light chain of the first antibody containing the target region, wherein the nucleic acid molecules contain one codon that encodes an amino acid in the target region compared to the corresponding codon of the unmodified variable heavy or variable light chain that does not encode the neutral amino acid, whereby each nucleic acid molecule of the plurality encodes a variable heavy chain or variable light chain that is modified by replacement of a single amino acid residue to a neutral amino acid residue in the target region.

Further, in a method where scanning mutagenesis is performed on a target region, a second antibody can be selected that exhibits an activity that is at least or about 75%, 80%, 85%, 90%, 95%, 100%, 105%, 110%, 115%, 120%, 130%, 140%, 150%, 200% or more of the activity of the corresponding form of the first antibody. After selecting the antibody that exhibits retained or increased activity, the amino acid residue position that is modified in the second antibody to contain a scanned acid compared to the first antibody not containing the amino acid replacement can be determined.

In examples of the affinity maturation method herein where scanning mutagenesis is employed, the scanned amino acid can be alanine, threonine, proline or glycine. For example, the scanned amino acid is alanine. The scanned amino acid also can be a non-natural amino acid.

Further, when performing scanning mutagenesis in the methods herein, a subset of the amino acid residues in the target region are modified by amino acid replacement to a scanned amino acid. In one example, only the amino acid residues that differ between the first antibody and related antibody in the target region are modified by amino acid replacement to a scanned amino acid. In another example, only the amino acid residues that are the same between the first antibody and the related antibody in the target region are modified by amino acid replacement to a scanned amino acid. In an additional example, all of the amino acids in the target region are modified by amino acid replacement to a neutral amino acid.

In the affinity maturation methods herein, the selected modified antibody exhibits 2-fold, 5-fold, 10-fold, 100-fold, 200-fold, 300-fold, 400-fold, 500-fold, 600-fold, 700-fold, 800-fold, 900-fold, 1000-fold, 2000-fold, 3000-fold, 4000-fold, 5000-fold, 10000-fold or more improved activity for the target antigen compared to the first antibody. For example, the modified antibody exhibits a binding affinity that is greater than the binding affinity of the first antibody and is or is about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $6\times10^{-10}$ M, $7\times10^{-10}$ M, $8\times10^{-10}$ M, $9\times10^{-10}$ M or less.

In the methods herein, the amino acid modifications that are altered in the modified antibody compared to the first antibody not containing the amino acid replacements can be determined. Further, the method of affinity maturation provided herein can be repeated iteratively where a modified antibody is selected and is used as the first for subsequent affinity maturation thereof. In addition, in the methods herein, one or more amino acid replacements in the target region of one or more variable heavy chains or one or more variable light chains of selected modified antibodies are combined to generate a further modified antibody, whereby the further modified antibodies are screened for an activity to the target antigen to identify a further modified antibody that exhibits an increased activity for the target antigen compared to the first antibody and to the selected modified antibodies.

In the affinity maturation methods herein, the method can be performed on the variable heavy chain of the first antibody and first modified antibodies selected each containing an amino acid replacement in the target region. Then, independent and separately, the method can be performed on the variable light chain of the first antibody and a second modified antibodies each containing an amino acid replacement in the target region can be selected. The variable heavy chain of a first modified antibody can be combined with the variable light chain of a second modified antibody to generate a plurality of different third modified antibodies each comprising an amino acid replacement in the target region of the variable heavy chain and variable light chain. Such third antibodies can be screened for an activity to the target antigen, and further modified antibodies that exhibit an increased activity for the target antigen compared to the first and second modified antibodies can be selected.

Further, in any of the methods herein, other regions of the antibody can be optimized. For example, after selecting a modified antibody, another different region within the variable heavy chain or variable light chain of the first modified antibody can be selected for further mutagenesis. In such an example, a plurality of nucleic acid molecules that encode modified forms of the variable heavy chain or variable light chain of the first modified antibody can be produced, wherein the nucleic acid molecules contain one codon encoding an amino acid in the selected region that encodes a different amino acid from the first modified variable heavy or variable light chain, whereby each nucleic acid molecule of the plurality encodes a variable heavy chain or variable light chain that is modified in the selected region by replacement of a single amino acid residue. A plurality of further modified antibodies then are produced each containing a variable heavy chain and a variable light chain, or a portion thereof, wherein at least one of the variable heavy chain or variable light chain is modified, whereby the selected region in each of the plurality of antibodies contains replacement of an amino acid to a different amino acid compared to the first modified antibody. The further modified antibodies are screen for activity for the target antigen those further modified antibodies that exhibit increased activity for the target antigen compared to the first modified antibody are selected. In such examples, the different region that is modified can be a CDR1, CDR2, CDR3, FR1, FR2, FR3 or FR4.

In any of the affinity maturation methods herein, any of the antibodoes can include an antibody or portion thereof. Such antibodies can be a Fab, Fab', F(ab')$_2$, single-chain Fv (scFv), Fv, dsFv, diabody, Fd and Fd' fragments, Fab fragments, Fd fragments, scFv fragments, and scFab fragments.

Provided herein is a method of affinity maturation based on scanning mutagenesis. In the method, scanning mutagenesis of a first antibody is performed by producing a plurality of nucleic acid molecules that encode modified forms of a variable heavy chain or a variable light chain of a first antibody, wherein the nucleic acid molecules contain one codon that encodes another amino acid compared to the corresponding codon of the unmodified variable heavy or variable light chain that does not encode the other amino acid, whereby each nucleic acid molecule of the plurality encodes a variable heavy chain or variable light chain that is modified by replacement of a single amino acid residue to another amino acid such that every position across the full-length of the encoded variable heavy or light chain is replaced or every position in a selected region of the encoded variable heavy or variable light chain is replaced, whereby each replacement is to the same amino acid residue. A plurality of modified antibodies are then produced each containing a variable heavy chain and a variable light chain, or a portion thereof, whereby each of the plurality of antibodies contains replacement of an amino acid position with another amino acid compared to the first antibody. The plurality of modified antibodies are screened for an activity to the target antigen. A second antibody is selected from among the modified antibodies that exhibits retained or increased activity for the target antigen compared to the first antibody not containing the amino acid replacement. Further mutagenesis of the second antibody is performed by producing a plurality of nucleic acid molecules that encode modified forms of a variable heavy chain or a variable light chain of the second antibody, wherein the nucleic acid molecules contain one codon encoding an amino acid at the scanned amino acid position that encodes a different amino acid than the scanned amino acid in the second antibody, whereby each nucleic acid molecule of the plurality encodes a variable heavy chain or variable light chain that is modified at the scanned amino acid position by a single amino acid residue. A plurality of further modified antibodies are produced each containing a variable heavy chain and a variable light chain, or a portion thereof whereby the scanned amino acid position contains replacement to a different amino acid compared to the second antibody. The further modified antibodies are screened for an activity to the target antigen. From among the further modified antibodies, a third antibody is selected that exhibits increased activity for the target antigen compared to the first antibody or compared to the second antibody.

In one example of the scanning affinity maturation method provided herein, every position in a region of the encoded variable heavy or variable light chain is replaced. The selected region can be a complementary determining region in the variable heavy chain or variable light chain selected that is a CDRH1, CDRH2, CDRH3, CDRL1, CDRL2 and CDRL3.

In the method herein, a second antibody containing a scanning mutation is selected that exhibits retained or increased binding compared to the first antibody. Generally, the second antibody that is selected exhibits an activity that is at least or about 75%, 80%, 85%, 90%, 95%, 100%, 105%, 110%, 115%, 120%, 130%, 140%, 150%, 200% or more of the activity of the corresponding form of the first antibody.

In the affinity maturation method provided herein, the amino acid residue position that is modified in the second antibody to contain a scanned amino acid compared to the first antibody not containing the amino acid replacement can be determined.

In the scanning methods of affinity maturation provided herein, the scanning amino acid residue can be an alaninie, threonine, proline and glycine. For example, the amino acid is an alanine. In other examples, the scanning amino acid is a non-natural amino acid. In the methods herein, each of the plurality of nucleic acid molecules encodes a variable heavy chain or variable light chain that is modified by replacement of a single amino acid residue to the same scanned amino acid. In the method, the scanned amino acid position is modified by amino acid replacement to all other amino acid residues, or to a restricted subset thereof.

In the scanning methods of affinity maturation provided herein, once a second antibody is selected, further modification of the antibody is effected. In the method, modification does not include amino acid replacement to the scanned amino acid or to the original amino acid at that position in the first antibody. The further modification of the second antibody can be effected by a method that is PCR mutagenesis, cassette mutagenesis, site-directed mutagenesis, random point mutagenesis, mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient host strains, restriction-selection and restriction-purification, deletion mutagenesis, mutagenesis by total gene synthesis, and double-strand break repair. In one example, further mutations are made by NNK, NNS, NNN, NNY or NNR mutagenesis.

In the scanning methods of affinity maturation provided herein, the activity that is assessed is binding, signal transduction, differentiation, alteration of gene expression, cellular proliferation, apoptosis, chemotaxis, cytotoxicity, cancer cell invasion, endothelial cell proliferation and tube formation. For example, where the activity is binding, binding is assessed by immunoassay, whole cell panning and surface plasmon resonance (SPR). The immunoassay can be a radioimmunoassay, enzyme linked immunosorbent assay (ELISA) or electrochemiluminescence assay. For example, the electrochemiluminescence assay can be meso scale discovery (MSD).

In the scanning methods of affinity maturation provided herein, the target antigen is a polypeptide, carbohydrate, lipid, nucleic acid or a small molecule. The target antigen can be expressed on the surface of a virus, bacteria, tumor or other cell, or is a recombinant protein or peptide. The target antigen can a protein that is a target for therapeutic intervention. For example, the target antigen is involved in cell proliferation and differentiation, cell migration, apoptosis or angiogenesis. Exemplary target antigen include a VEGFR-1, VEGFR-2, VEGFR-3 (vascular endothelial growth factor receptors 1, 2, and 3), a epidermal growth factor receptor (EGFR), ErbB-2, ErbB-3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epidermal growth factor homology domains receptor), CSF1R (colony stimulating factor 1 receptor), PDGFRB (platelet-derived growth factor receptor B), EPHA1, EPHA2, EPHB1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R, EPO-R., a cadherin, an integrin, CD52, CD44, VEGF-A, VEGF-B, VEGF-C, VEGF-D, PIGF, EGF, HGF, TNF-α, LIGHT, BTLA, lymphotoxin (LT), IgE, G-CSF, GM-CSF and EPO.

In the scanning methods herein, the third antibody exhibits 2-fold, 5-fold, 10-fold, 100-fold, 200-fold, 300-fold, 400-fold, 500-fold, 600-fold, 700-fold, 800-fold, 900-fold, 1000-fold, 2000-fold, 3000-fold, 4000-fold, 5000-fold, 10000-fold or more improved activity for the target antigen compared to the first antibody or the second antibody. For example, where the first antibody binds to the target antigen with a binding affinity that is at or about $10^{-4}$ M, $10^{-5}$ M, $10^{-6}$ M, $10^{-7}$ M, $10^{-8}$ M, or lower, when the antibody is in a Fab form, the further optimized antibodies, such as the selected third antibody, are those that are optimized to have an improved binding affinity compared to the first antibody. For example, the third antibody exhibits a binding affinity that is greater than the binding affinity of the first antibody and is or is about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $6\times10^{-10}$M, $7\times10^{-10}$M, $8\times10^{-10}$ M, $9\times10^{-10}$ M or less.

In one aspect of the method, scanning mutagenesis is performed within the variable heavy chain of the first antibody, and the method performed therefrom. In another aspect, scanning mutagenesis is performed within the variable light chain of the first antibody, and steps of the method are performed therefrom. In an additional aspect of the method, scanning mutagenesis is performed within the variable heavy chain of the first antibody and steps of the method performed therefrom; and separately and independently scanning mutagenesis is performed within the variable light chain of the first antibody, and steps of the method are performed therefrom.

In the method herein, further optimization can be achieved. The method can include determining the amino acid modifications that are altered in the third antibody compared to the first antibody not containing the amino acid replacements. Combination mutants can be generated. Also provided in the method herein, is a method that is repeated iteratively, wherein the third antibody identified in that is selected and used as the first antibody for subsequent maturation thereof, whereby the amino acid residue that is modified is not further modified in subsequent iterations of the method. In another example of optimization, one or more amino acid replacement in one or more variable heavy chains or one or more variable light chains of selected third antibodies are combined to generate a further modified antibody, whereby the further modified antibodies are screened for an activity to the target antigen to identify a further modified antibody that exhibits an increased activity for the target antigen compared to the first antibody, second antibody and to the selected third antibodies. For example, the steps of the method can be performed on the variable heavy chain of the first antibody and third antibodies selected each containing an amino acid replacement in the variable heavy chain compared to the corresponding variable heavy chain of the first antibody. Independently and separately, the steps of the method are performed on the variable light chain of the first antibody and different third modified antibodies are selected each containing an amino replacement in the variable light chain compared to the corresponding variable light chain of the first antibody. The variable heavy chain of a third antibody can be combined with the variable light chain of a different third antibody to generate a plurality of different further modified antibodies each containing an amino acid replacement of the variable heavy chain and variable light chain compared to the corresponding variable heavy chain and variable light chain of the first antibody. The further modified antibodies can be screened for activity (e.g. binding) to the target antigen; and those fourth antibodies that exhibit an increased activity for the target antigen compared to the first antibody, second antibody, and third antibodies are selected.

In another example, after selecting a third antibody another different region within the variable heavy chain or variable light chain of the third antibody is selected for further mutagenesis. In such a method, a plurality of nucleic acid molecules are produced that encode modified forms of the variable heavy chain or variable light chain of the third antibody, wherein the nucleic acids molecules contain one codon encoding an amino acid in the selected region that encodes a different amino acid from the first modified variable heavy or variable light chain, whereby each nucleic acid molecule of the plurality encodes a variable heavy chain or variable light chain that is modified in the selected region by replacement of a single amino acid residue. Then, a plurality of further modified antibodies are produced each containing a variable heavy chain and a variable light chain, or a portion thereof, whereby the selected region in each of the plurality of antibodies contains replacement of an amino acid to a different amino acid compared to the third antibody. The further modified antibodies are screened for an activity (e.g. binding) to the target antigen and those further modified antibodies that exhibit increased activity for the target antigen compared to the third antibody are selected. In such an example, the different region that is subject to further mutagenesis can be a CDR1, CDR2, CDR3, FR1, FR2, FR3 and FR4.

In any of the methods herein, the antibody can be an antibody or fragment thereof containing a variable heavy chain and a variable light chain, or a portion thereof. For example, the antibody can be a full-length antibody or a fragment thereof that is a Fab, Fab', F(ab')$_2$, single-chain Fv (scFv), Fv, dsFv, diabody, Fd and Fd' fragments, Fab fragments, Fd fragments, scFv fragments, and scFab fragments.

Also provided herein is a method of antibody conversion, whereby, following mutageneis of a first or reference antibody having a known activity, an antibody is selected that exhibits an activity that is changed or inverted compared to the activity of the first or reference antibody for the same target antigen. In one example of the method, an activity of an antibody is converted from an antagonist to an activator. In the method, a first antibody or fragment thereof that is an antagonist antibody is selected, whereby the antibody inhibits a functional activity associated with its target antigen. A plurality of modified antibodies is produced each containing a variable heavy chain and a variable light chain, or a portion thereof sufficient to bind antigen, where at least one of the variable heavy chain or variable light chain is modified such that it contains at least one amino acid modification compared to the first antibody. For example, amino acid modification is replacement of at least a single amino acid residue, such that each of the plurality of antibodies contains replacement of an amino acid(s) to a different amino acid(s) compared to the first antibody. In one example of the method, the plurality of modified antibodies are produced by producing a plurality of nucleic acid molecules that encode modified forms of a variable heavy chain or a variable light chain of the first antibody, wherein the nucleic acid molecules contain at least one codon that encodes a different amino acid from the unmodified variable heavy or variable light chain, such that each nucleic acid molecule of the plurality encodes a variable heavy chain or variable light chain that is modified by replacement of a single amino acid residue. Following mutagenesis, the plurality of modified antibodies are each screened for an activity to the target antigen. Antibodies are selected or identified that result in an increase in a functional activity associated with the target antigen compared to activity in the presence of the first antibody, thereby converting the first antibody to an activator.

In some examples of the method of converting an antagonist antibody to an activator, before the antibodies are screened for a functional activity the plurality of antibodies are each assessed for binding affinity for the target antigen. Antibodies that exhibit a binding affinity that is greater then the corresponding form of the first antibody for the target antigen are identified or selected. Then, that subset of antibodies are further screened for a functional activity to identify or select those that have a converted activator activity.

In another example of the method of antibody conversion, an activity of an antibody is converted from an activator to an antagonist. In the method, a first antibody or fragment thereof that is an activator antibody is selected, whereby the antibody increases a functional activity associated with its target antigen. A plurality of modified antibodies is produced each containing a variable heavy chain and a variable light chain, or a portion thereof sufficient to bind antigen, where at least one of the variable heavy chain or variable light chain is modified such that it contains at least one amino acid modification compared to the first antibody. For example, amino acid modification is replacement of at least a single amino acid residue, such that each of the plurality of antibodies contains replacement of an amino acid(s) to a different amino acid(s) compared to the first antibody. In one example of the method, the plurality of modified antibodies are produced by producing a plurality of nucleic acid molecules that encode modified forms of a variable heavy chain or a variable light chain of the first antibody, wherein the nucleic acid molecules contain at least one codon that encodes a different amino acid from the unmodified variable heavy or variable light chain, such that each nucleic acid molecule of the plurality encodes a variable heavy chain or variable light chain that is modified by replacement of a single amino acid residue. Following mutagenesis, the plurality of modified antibodies are each screened for an activity to the target antigen. Antibodies are selected or identified that result in a decrease in a functional activity associated with the target antigen compared to activity in the presence of the first antibody, thereby converting the first antibody to an antagonist.

In some examples of the method of converting an activator antibody to an antagonist, before the antibodies are screened for a functional activity the plurality of antibodies are each assessed for binding affinity for the target antigen. Antibodies that exhibit a binding affinity that is lower then the corresponding form of the first antibody for the target antigen are identified or selected. Then, that subset of antibodies are further screened for a functional activity to identify or select those that have a converted antagonist activity.

In each of the conversion methods above, the target antigen is a VEGFR-1, VEGFR-2, VEGFR-3 (vascular endothelial growth factor receptors 1, 2, and 3), a epidermal growth factor receptor (EGFR), ErbB-2, ErbB-b3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epidermal growth factor homology domains receptor), CSF1R (colony stimulating factor 1 receptor), PDGFRB (platelet-derived growth factor receptor B), EPHA1, EPHA2, EPHB1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R or EPO-R.

Provided herein is an anti-DLL4 antibody multimer that has a binding affinity for DLL4 that is $10^{-8}$ M or lower binding affinity as measured by surface plasmon resonance (SPR) as a monomeric Ig fragment and that is an activator of DLL4 activity. For example, the binding affinity is between $10^{-6}$ M to $10^{-8}$ M. The antibody multimer can be, for example, a full-length antibody, a F(ab')$_2$ or a scFv dimer. In some examples, that antibody multimer is a full-length antibody that contains a constant region from a constant region of IgG1, IgG2, IgG3, IgA or IgM. For example, the constant region is an IgG1 constant region, or modified form thereof.

In one example, the antibody multimer contains a heavy chain CDR1 (CDRH1) set forth in SEQ ID NO:2908, a heavy chain CDR2 (CDRH2) set forth in SEQ ID NO:2909, a heavy chain CDR3 (CDRH3) set forth in SEQ ID NO: 2910, a light chain CDR1 (CDRL1) set forth in SEQ ID NO:2911, a light chain CDR2 (CDRL2) set forth in SEQ ID NO:2912, and a light chain CDR3 (CDRL3) set forth in SEQ ID NO:2913; or contains a sequences of amino acids that exhibits at least 70% sequence identity to any of SEQ ID NOS: 2908-2913, whereby the antibody binds to DLL4 and is an activator of DLL4 activity. For example, the antibody multimer contains a heavy chain having a variable region set forth in SEQ ID NO: 88 and a light chain comprising a variable region set forth in SEQ ID NO:107.

In another example, the antibody multimer contains a a heavy chain CDR1 (CDRH1) set forth in SEQ ID NO:2914, a heavy chain CDR2 (CDRH2) set forth in SEQ ID NO:2915, a heavy chain CDR3 (CDRH3) set forth in SEQ ID NO: 2916, a light chain CDR1 (CDRL1) set forth in SEQ ID NO:2917, a light chain CDR2 (CDRL2) set forth in SEQ ID NO:2918, and a light chain CDR3 (CDRL3) set forth in SEQ ID NO:2919; or contains a sequences of amino acids that exhibits at least 70% sequence identity to any of SEQ ID NOS: 2914-2919, whereby the antibody binds to DLL4 and is an activator of DLL4 activity. For example, the antibody multimer contains a heavy chain having a variable region set forth in SEQ ID NO: 89 and a light chain comprising a variable region set forth in SEQ ID NO:108.

In examples of antibody multimers provided herein, the the heavy chain can contain an IgG1 constant region (e.g. set forth in SEQ ID NO: 2922) a light chain constant region, lambda or kappa (e.g. set forth in SEQ ID NO: 2923 or 2924).

Provided herein is a method of treating aberrant angiogenesis associated with an angiogenic disease or condition by administering any of the antibody multimers provided herein to a subject, whereby the activity of a DLL4 receptor is increased. For example, the DLL4 receptor is Notch-1 or Notch-4. The angiogenic disease or condition can be a cancer, diabetic retinopathies and other diabetic complications, inflammatory diseases, endometriosis and age-related macular degeneration.

BRIEF DESCRIPTION OF THE FIGURES

FIG. 1: is a flow chart that illustrates the method of structure-affinity/activity relationship (SAR) based affinity maturation.

FIG. 2: Amino acid alignments of "Hit" Fab VH1-46_IGHD6-6*01_IGHJ1*01 & L6_IGKJ1*01. FIG. 2A shows the alignment of the variable heavy chain of "Hit" Fab VH1-46_IGHD6-6*01_IGHJ1*01 & L6_IGKJ1*01 (SEQ ID NOS:88 and 107) with the variable heavy chain of "non-Hit" Fab VH1-46_IGHD6-13*01_IGHJ4*01 & L6_IGKJ1*01 (SEQ ID NOS:93 and 107). FIG. 2B shows the alignment of the variable light chain of "Hit" Fab VH1-46_IGHD6-6*01_IGHJ1*01 & L6_IGKJ1*01 (SEQ ID NOS:88 and 107) with the variable light chains of "non-Hit" Fabs VH1-46_IGHD6-6*01_IGHJ1*01 & A27_IGKJ1*01 (SEQ ID NOS:8 and 110), VH1-46_IGHD6-6*01_IGHJ1*01 & L25_IGKJ1*01 (SEQ ID NOS:88 and 120) and VH1-46_IGHD6-6*01_IGHJ1*01 & L2_IGKJ1*01 (SEQ ID NOS:88 and 112). The regions of variation are highlighted in grey. The amino acid sequence of the "Hit" Fab VH1-46_IGHD6-6*01_IGHJ1*01 & L6_IGKJ1*01 is shown in bold.

FIG. 3: Amino acid alignment of the variable heavy chain of "Hit" Fab VH5-51_IGHD5-18*01>3_ IGHJ4*01 & V3-4_IGLJ1*01. FIG. 3 shows the alignment of the variable heavy chain of "Hit" Fab VH5-51_IGHD5-18*01>3_IGHJ4*01 & V3-4_IGLJ1*01 (SEQ ID NOS:89 and 108) with the variable heavy chain of "non-Hit" Fab VH5-51_IGHD6-25*01_IGHJ4*01 & V3-4_IGLJ1*01 (SEQ ID NOS:106 and 108). The regions of variation are highlighted in grey. The amino acid sequence of the "Hit" Fab VH5-51_IGHD5-18*01>3_IGHJ4*01 & V3-4_IGLJ1*01 is shown in bold.

FIGS. 4A-4C: Amino acid alignments of germline swapped variable heavy chains. FIG. 4A shows the alignment of the variable heavy chain of "Hit" Fab VH1-46_IGHD6-6*01_IGHJ1*01 & L6_IGKJ1*01 (SEQ ID NOS:88 and 107) with the variable heavy chains of J segment germline swapped Fabs VH1-46_IGHD6-6*01_IGHJ2*01 & L6_IGKJ1*01 (SEQ ID NOS:585 and 107), VH1-46_IGHD6-6*01_IGHJ4*01 & L6_IGKJ1*01 (SEQ ID NOS:586 and 107) and VH1-46_IGHD6-6*01_IGHJ5*01 & L6_IGKJ1*01 (SEQ ID NOS:587 and 107). FIG. 4B shows the alignment of the variable heavy chain of "Hit" Fab VH5-51_IGHD5-18*01>3_IGHJ4*01 & V3-4_IGLJ1*01 (SEQ ID NOS:89 and 108) with the variable heavy chains of J segment germline swapped Fabs VH5-51_IGHD5-18*01>3_IGHJ1*01 & V3-4_IGLJ1*01 (SEQ ID NOS:588 and 108), VH5-51_IGHD5-18*01>3_IGHJ3*01 & V3-4_IGLJ4*01 (SEQ ID NOS:589 and 108) and VH5-51IGHD5-18*01>3_IGHJ5*01 & V3-4_IGLJ1*01 (SEQ ID NOS:590 and 108). FIG. 4C shows the alignment of the variable heavy chain of "Hit"

Fab VH5-51_IGHD5-18*01>3_IGHJ4*01 & V3-4_IGLJ1*01 (SEQ ID NOS:89 and 108) with the variable heavy chains of D segment germline swapped Fabs VH5-51_IGHD5-12*01_IGHJ4*01 & V3-4_IGLJ1*01 (SEQ ID NOS:591 and 108) and VH5-51_IGHD5-24*01_IGHJ4*01 & V3-4_IGLJ1*01 (SEQ ID NOS:592 and 108). The regions of variation are highlighted in grey. The amino acid sequence of the "Hit" Fab VH1-46_IGHD6-6*01_IGHJ1*01 & L6_IGKJ1*01 is shown in bold.

FIG. 5: Amino acid alignment of the variable heavy chain of "Hit" Fab VH3-23_IGHD2-21*01>3_IGHJ6*01 & V2-13_IGLJ2*01. FIG. 5 shows the alignment of the variable heavy chain of "Hit" Fab VH3-23_IGHD2-21*01>3_IGHJ6*01 & V2-13 IGLJ2*01 (SEQ ID NOS: 1729 and 594) with the variable heavy chains of related "Hit" Fabs VH3-23_IGHD2-2*01>3_IGHJ6*01 & V2-13 IGLJ2*01 (SEQ ID NOS:1723 and 594), VH3-23_IGHD2-8*01>3_IGHJ6*01 & V2-13 IGLJ2*01 (SEQ ID NOS:1725 and 594) and VH3-23_IGHD2-15*01>3_IGHJ6*01 & V2-13 IGLJ2*01 (SEQ ID NOS:1727 and 594). The regions of variation are highlighted in grey. The amino acid sequence of the "Hit" Fab VH3-23_IGHD2-21*01>3_IGHJ6*01 & V2-13 IGLJ2*01 is shown in bold.

DETAILED DESCRIPTION

Outline
A. Definitions
B. Overview of Methods
  1. Antibody Polypeptides
    a. Antibody Structure and Function
    b. Antibody Sequence and Specificity
  2. Methods of Identifying Antibodies
  3. Existing Methods of Optimizing Antibodies
C. Method for Affinity Maturation of Antibodies
  1. Comparison of Structure and Activity
    a. Selection of a First Antibody for Affinity Maturation
      i Immunization and Hybridoma Screening
      ii. Screening Assays for Identification of a "Hit"
        1) Display Libraries
        2) Phage Display Libraries
        3) Addressable Libraries
    b. Identification of a Related Antibody
    c. Comparison of the amino acid sequences of the First Antibody and Related Antibodies
    d. Mutagenesis of an Identified Region
  2. SAR by Scanning Mutagenesis
  3. Further Optimization
    a. Complementarity Determining Regions
    b. Framework Regions
    c. Germline Swapping
D. Method of Antibody Conversion
  1. Choosing the Starting or Reference Antibody
  2. Mutagenesis
  3. Selecting for a Converted Antibody
    a. Binding
    b. Functional Activity
E. Assays
  1. Binding Assays
  2. Functional Activity
    a. Differentiation
    b. Alteration of Gene Expression
    c. Cytotoxicity Assay
  3. In Vivo Assays
F. Methods of Production of Antibodies
  1. Vectors
  2. Cells and Expression System
    a. Prokaryotic Expression
    b. Yeast
    c. Insects
    d. Mammalian cells
    e. Plants
  3. Purification
G. Anti-DLL4 Activator/Modulator Antibodies and Uses Thereof
  1. DLL4
    a. Structure
    b. Expression
    c. Function
  2. Activator/Modulator Anti-DLL4 Multimer Antibodies
    Exemplary Antibodies
  3. Modifications
    a. Modifications to Reduce Immunogenicity
    b. Glycosylation
    c. Fc Modifications
    d. PEGylation
  4. Compositions, Formulations, Administration and Articles of Manufacture/Kits
    a. Compositions and Formulations
    b. Articles of Manufacture and Kits
  5. Methods of Treatment and Uses
    Combination Therapy
H. Examples A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, an antibody refers to immunoglobulins and immunoglobulin portions, whether natural or partially or wholly synthetic, such as recombinantly, produced, including any portion thereof containing at least a portion of the variable region of the immunoglobulin molecule that is sufficient to form an antigen binding site. Hence, an antibody or portion thereof includes any protein having a binding domain that is homologous or substantially homologous to an immunoglobulin antigen binding site. For example, an antibody refers to an antibody that contains two heavy chains (which can be denoted H and H') and two light chains (which can be denoted L and L'), where each heavy chain can be a full-length immunoglobulin heavy chain or a portion thereof sufficient to form an antigen binding site (e.g. heavy chains include, but are not limited to, VH chains VH-CH1 chains and VH-CH1-CH2-CH3 chains), and each light chain can be a full-length light chain or a portion thereof sufficient to form an antigen binding site (e.g. light chains include, but are not limited to, VL chains and VL-CL chains). Each heavy chain (H and H') pairs with one light chain (L and L', respectively). Typically, antibodies minimally include all or at least a portion of the variable heavy (VH) chain and/or the variable light (VL) chain. The antibody also can include all or a portion of the constant region.

For purposes herein, the term antibody includes full-length antibodies and portions thereof including antibody fragments, such as, but not limited to, Fab, Fab', F(ab')$_2$, single-chain Fvs (scFv), Fv, dsFv, diabody, Fd and Fd' fragments Fab fragments, Fd fragments and scFv fragments. Other known fragments include, but are not limited to, scFab fragments (Hust et al., *BMC Biotechnology* (2007), 7:14). Antibodies include members of any immunoglobulin class, including IgG, IgM, IgA, IgD and IgE.

As used herein, a full-length antibody is an antibody having two full-length heavy chains (e.g. VH-CH1-CH2-CH3 or VH-CH1-CH2-CH3-CH4) and two full-length light chains (VL-CL) and hinge regions, such as human antibodies produced by antibody secreting B cells and antibodies with the same domains that are produced synthetically.

As used herein, antibody fragment or antibody portion with reference to a "portion thereof" or "fragment thereof" of an antibody refers to any portion of a full-length antibody that is less than full length but contains at least a portion of the variable region of the antibody sufficient to form an antigen binding site (e.g. one or more CDRs) and thus retains the a binding specificity and/or an activity of the full-length antibody; antibody fragments include antibody derivatives produced by enzymatic treatment of full-length antibodies, as well as synthetically, e.g. recombinantly produced derivatives. Examples of antibody fragments include, but are not limited to, Fab, Fab', F(ab')$_2$, single-chain Fvs (scFv), Fv, dsFv, diabody, Fd and Fd' fragments (see, for example, *Methods in Molecular Biology*, Vol 207: *Recombinant Antibodies for Cancer Therapy Methods and Protocols* (2003); Chapter 1; p 3-25, Kipriyanov). The fragment can include multiple chains linked together, such as by disulfide bridges and/or by peptide linkers. An antibody fragment generally contains at least about 50 amino acids and typically at least 200 amino acids.

Hence, reference to an "antibody or portion thereof that is sufficient to form an antigen binding site" means that the antibody or portion thereof contains at least 1 or 2, typically 3, 4, 5 or all 6 CDRs of the VH and VL sufficient to retain at least a portion of the binding specificity of the corresponding full-length antibody containing all 6 CDRs. Generally, a sufficient antigen binding site at least requires CDR3 of the heavy chain (CDRH3). It typically further requires the CDR3 of the light chain (CDRL3). As described herein, one of skill in the art knows and can identify the CDRs based on kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). For example, based on Kabat numbering, CDR-LI corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H102.

As used herein, "antigen-binding site" refers to the interface formed by one or more complementary determining regions (CDRs; also called hypervariable region). Each antigen binding site contains three CDRs from the heavy chain variable region and three CDRs from the light chain variable region. An antibody molecule typically has two antigen combining sites, each containing portions of a heavy chain variable region and portions of a light chain variable region. The antigen combining sites can contain other portions of the variable region domains in addition to the CDRs.

As used herein, an Fv antibody fragment is composed of one variable heavy domain (VH) and one variable light (VL) domain linked by noncovalent interactions.

As used herein, a dsFv refers to an Fv with an engineered intermolecular disulfide bond, which stabilizes the VH-VL pair.

As used herein, an Fd fragment is a fragment of an antibody containing a variable domain (VH) and one constant region domain (CH1) of an antibody heavy chain.

As used herein, "Fab fragment" is an antibody fragment that contains the portion of the full-length antibody that results from digestion of a full-length immunoglobulin with papain, or a fragment having the same structure that is produced synthetically, e.g. recombinantly. A Fab fragment contains a light chain (containing a VL and CL portion) and another chain containing a variable domain of a heavy chain (VH) and one constant region domain portion of the heavy chain (CH1); it can be recombinantly produced.

As used herein, a F(ab')$_2$ fragment is an antibody fragment that results from digestion of an immunoglobulin with pepsin at pH 4.0-4.5, or a synthetically, e.g. recombinantly, produced antibody having the same structure. The F(ab')2 fragment contains two Fab fragments but where each heavy chain portion contains an additional few amino acids, including cysteine residues that form disulfide linkages joining the two fragments; it can be recombinantly produced.

A Fab' fragment is a fragment containing one half (one heavy chain and one light chain) of the F(ab')2 fragment.

As used herein, an Fd' fragment is a fragment of an antibody containing one heavy chain portion of a F(ab')2 fragment.

As used herein, an Fv' fragment is a fragment containing only the $V_H$ and $V_L$ domains of an antibody molecule.

As used herein, a scFv fragment refers to an antibody fragment that contains a variable light chain (VL) and variable heavy chain (VH), covalently connected by a polypeptide linker in any order. The linker is of a length such that the two variable domains are bridged without substantial interference. Exemplary linkers are (Gly-Ser)$_n$ residues with some Glu or Lys residues dispersed throughout to increase solubility.

As used herein, diabodies are dimeric scFv; diabodies typically have shorter peptide linkers than scFvs, and they preferentially dimerize.

As used herein, hsFv refers to antibody fragments in which the constant domains normally present in a Fab fragment have been substituted with a heterodimeric coiled-coil domain (see, e.g., Arndt et al. (2001) *J Mol Biol.* 7:312:221-228).

As used herein, an "antibody multimer" refers to an antibody containing at least two or more antigen-binding sites. Antibody multimers include dimers, trimer, tetramers pentamers, and higher ordered oligomers. Formation of an antibody as a multimer can be achieved based on the knowledge of one of skill in the art. For example, multimeric forms include antibody oligomers that form via a multimerization domain that coordinates or facilitates the interaction of at least two polypeptides or a covalent bond.

As used herein, a multimerization domain refers to a sequence of amino acids that promotes stable interaction of a polypeptide molecule with one or more additional polypeptide molecules, each containing a complementary multimerization domain, which can be the same or a different multimerization domain to form a stable multimer with the first domain. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the constant domain or portions thereof from IgG, including IgG1, IgG2, IgG3 or IgG4 subtypes, IgA, IgE, IgD and IgM and modified forms thereof.

As used herein, a "monospecific" is an antibody that contains two or more antigen-binding sites, where each antigen-binding site immunospecifically binds to the same epitope.

As used herein, a "multispecific" antibody is an antibody that contains two or more antigen-binding sites, where at least two of the antigen-binding sites immunospecifically bind to different epitopes.

As used herein, a "bispecific" antibody is a multispecific antibody that contains two or more antigen-binding sites and can immunospecifically bind to two different epitopes. A "trispecific" antibody is a multispecific antibody that contains three or more antigen-binding sites and can immunospecifically bind to three different epitopes, a "tetraspecific" antibody is a multispecific antibody that contains four or more antigen-binding sites and can immunospecifically bind to four different epitopes, and so on.

As used herein, reference to a "monomeric Ig fragment" refers to an antibody portion that contains only one antigen-binding site. For example, a monomeric Ig fragment includes, for example, a Fab, Fv or a scFv.

As used herein, a polypeptide domain is a part of a polypeptide (a sequence of three or more, generally 5 or 7 or more amino acids) that is a structurally and/or functionally distinguishable or definable. Exemplary of a polypeptide domain is a part of the polypeptide that can form an independently folded structure within a polypeptide made up of one or more structural motifs (e.g. combinations of alpha helices and/or beta strands connected by loop regions) and/or that is recognized by a particular functional activity, such as enzymatic activity or antigen binding. A polypeptide can have one, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of domains. For example, each heavy chain and each light chain of an antibody molecule contains a plurality of immunoglobulin (Ig) domains, each about 110 amino acids in length.

As used herein, an Ig domain is a domain, recognized as such by those in the art, that is distinguished by a structure, called the Immunoglobulin (Ig) fold, which contains two beta-pleated sheets, each containing anti-parallel beta strands of amino acids connected by loops. The two beta sheets in the Ig fold are sandwiched together by hydrophobic interactions and a conserved intra-chain disulfide bond. Individual immunoglobulin domains within an antibody chain further can be distinguished based on function. For example, a light chain contains one variable region domain (VL) and one constant region domain (CL), while a heavy chain contains one variable region domain (VH) and three or four constant region domains (CH). Each VL, CL, VH, and CH domain is an example of an immunoglobulin domain.

As used herein, a "variable domain" with reference to an antibody is a specific Ig domain of an antibody heavy or light chain that contains a sequence of amino acids that varies among different antibodies. Each light chain and each heavy chain has one variable region domain (VL, and, VH). The variable domains provide antigen specificity, and thus are responsible for antigen recognition. Each variable region contains CDRs that are part of the antigen binding site domain and framework regions (FRs).

As used herein, reference to a variable heavy (VH) chain or a variable light (VL) chain (also termed VH domain or VL domain) refers to the polypeptide chains that make up the variable domain of an antibody.

As used herein, a "region" of an antibody refers to a domain of an antibody or a portion of a domain is associated with a particular function or structure. In an antibody, regions of an antibody include the complementarity-determining region, the framework region, and/or the constant region. Generally, for purposes herein, a region of an antibody is a complementarity determining region CDR1, CDR2 and/or CDR3 of the variable light chain or variable heavy chain (CDRL1, CDRL2, CDRL3, CDRH1, CDRH2, or CDRH3), or is a framework region FR1, FR2 or FR3 of the variable light chain or variable heavy chain.

As used herein, "hypervariable region," "HV," "complementarity-determining region" and "CDR" and "antibody CDR" are used interchangeably to refer to one of a plurality of portions within each variable region that together form an antigen binding site of an antibody. Each variable region domain contains three CDRs, named CDR1, CDR2, and CDR3. The three CDRs are non-contiguous along the linear amino acid sequence, but are proximate in the folded polypeptide. The CDRs are located within the loops that join the parallel strands of the beta sheets of the variable domain.

As used herein, framework regions (FRs) are the regions within the antibody variable region domains that are located within the beta sheets; the FR regions are comparatively more conserved, in terms of their amino acid sequences, than the hypervariable regions.

As used herein, a constant region domain is a domain in an antibody heavy or light chain that contains a sequence of amino acids that is comparatively more conserved among antibodies than the variable region domain. Each light chain has a single light chain constant region (CL) domain and each heavy chain contains one or more heavy chain constant region (CH) domains, which include, CH1, CH2, CH3 and CH4. Full-length IgA, IgD and IgG isotypes contain CH1, CH2 CH3 and a hinge region, while IgE and IgM contain CH1, CH2 CH3 and CH4. CH1 and CL domains extend the Fab arm of the antibody molecule, thus contributing to the interaction with antigen and rotation of the antibody arms. Antibody constant regions can serve effector functions, such as, but not limited to, clearance of antigens, pathogens and toxins to which the antibody specifically binds, e.g. through interactions with various cells, biomolecules and tissues.

As used herein, humanized antibodies refer to antibodies that are modified to include "human" sequences of amino acids so that administration to a human does not provoke an immune response. Methods for preparation of such antibodies are known. For example, the antibody in which the amino acid composition of the non-variable regions can be based on human antibodies. Computer programs have been designed to identify such regions.

As used herein, "antibody conversion" refers to a process in which the functional activity of an antibody or fragment thereof for a target antigen or substrate is changed, typically by mutation of one or more amino acid residues, to have an inverse functional activity of the starting or reference antibody. For example, if the starting or reference antibody exhibits antagonist activity for a target antigen, antibody coversion changes the antibody to an agonist or activator/modulator activity. In another example, if the starting or reference antibody exhibits activator/modulator activity for a target antigen, antibody conversion changes the antibody to an antagonist activity.

As used herein, "affinity maturation" refers to a process in which an antibody is evolved from a reference antibody (also referred to herein as a template or parent antibody), typically by mutation of one or more amino acid residues, to have increased activity for a target antigen than a corresponding form of the reference antibody has for the same target antigen. Hence, the evolved antibody is optimized compared to the reference or template antibody.

As used herein, reference to an affinity matured antibody refers to an antibody that has an increased activity for a target antigen relative to a reference antibody. For example, the affinity matured antibody exhibits increased binding to the target antigen compared to the reference or parent antibody. Typically, the affinity matured antibody binds to the same epitope as the reference antibody.

As used herein, an optimized antibody refers to an antibody, or portion thereof, that has an increased activity for a target protein or antigen compared to a reference antibody, for example, improved binding affinity for a target protein and/or an improved functional activity. Typically, the antibody is optimized by virtue of one or more amino acid modifications (amino acid deletion, replacement or insertion) compared to a parent antibody not containing the one or more amino acid modifications. Generally, an activity, for example binding affinity, is increased by at or about 1.5-fold to 1000-fold, generally at least or about 2-fold to 100-fold, for example at or about 1.5-fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to an activity of the parent antibody (e.g. germline antibody Hit not containing the modification(s)).

As used herein, "structure affinity/activity relationship" (SAR) refers to the relationship between structure (e.g. sequence) and function of a molecule, whereby the activity of an antibody can be correlated to it sequence. Thus, knowledge of the SAR elucidates a region of a sequence, including particular amino acid residues, that contribute to the activity of an antibody. Methods of determining SAR are described herein.

As used herein, activity towards a target protein or target antigen refers to binding specificity or binding affinity and/or modulation of a functional activity of a target protein, or other measurements that reflects the activity of an antibody or portion thereof towards a target protein. Activity of an antibody can be measured using a binding or affinity based assay, such as an ELISA, electrochemiluminescence assay (e.g. Meso Scale Discovery), or surface plasmon resonance, or can measured using a cell based assay as described herein.

As used herein, "functional activity" refer to activities of a polypeptide (e.g. target protein) or portion thereof associated with a full-length (complete) protein. Functional activities include, but are not limited to, biological activity, catalytic or enzymatic activity, antigenicity (ability to bind to or compete with a polypeptide for binding to an antipolypeptide antibody), immunogenicity, ability to form multimers, the ability to specifically bind to a receptor or ligand for the polypeptide and signaling and downstream effector functions. For purposes herein, modulation (i.e. activation or inhibition) of a functional activity of a polypeptide by an antibody or portion thereof herein means that a functional activity of the polypeptide is changed or altered in the presence of the antibody compared to the absence of the antibody or portion thereof.

As used herein, binding activity refer to characteristics of a molecule, e.g. a polypeptide, relating to whether or not, and how, it binds one or more binding partners. Binding activities include ability to bind the binding partner(s), the affinity with which it binds to the binding partner (e.g. high affinity), the avidity with which it binds to the binding partner, the strength of the bond with the binding partner and specificity for binding with the binding partner.

As used herein, "affinity" or "binding affinity" refers to the strength with which an antibody molecule or portion thereof binds to an epitope on a target protein or antigen. Affinity is often measured by equilibrium association constant ($K_A$) or equilibrium dissociation constant ($K_D$). Low-affinity antibody-antigen interaction is weak, and the molecules tend to dissociate rapidly, while high affinity antibody-antigen binding is strong and the molecules remain bound for a longer amount of time. Generally, affinity of an antibody to a target protein is with an equilibrium association constant ($K_A$) of greater than or equal to about $10^6 M^{-1}$, greater than or equal to about $10^7 M^{-1}$, greater than or equal to about $10^8 M^{-1}$, or greater than or equal to about $10^9 M^{-1}$, $10^{10} M^{-1}$, $10^{11} M^{-1}$ or $10^{12} M^{-1}$. Antibodies also can be characterized by an equilibrium dissociation constant ($K_D$) $10^{-4}M$, $10^{-6}M$ to $10^{-7}M$, or $10^{-8}M$, $10^{-10}M$, $10^{-11}M$ or $10^{-12}M$ or lower dissociation constant. It is understood that a lower dissociation constant means that the antibody is characterized by a higher binding affinity. Generally, antibodies having a nanomolar or sub-nanomolar dissociation constant are deemed to be high affinity antibodies. Such affinities can be readily determined using conventional techniques, such as by equilibrium dialysis; by using the BIAcore 2000 instrument, using general procedures outlined by the manufacturer; by radioimmunoassay using radiolabeled target antigen; or by another method known to the skilled artisan. The affinity data can be analyzed, for example, by the method of Scatchard et al., Ann N.Y. Acad. ScL, 51:660 (1949).

As used herein, "specifically bind" or "immunospecifically bind" with respect to an antibody or antigen-binding fragment thereof are used interchangeably herein and refer to the ability of the antibody or antigen-binding fragment to form one or more noncovalent bonds with a cognate antigen, by noncovalent interactions between the antibody combining site(s) of the antibody and the antigen (e.g. human DLL4). Typically, an antibody that immunospecifically binds (or that specifically binds) to an antigen is one that binds to the antigen with an affinity constant Ka of about or $1 \times 10^7 M^{-1}$ or $1 \times 10^8 M^{-1}$ or greater (or a dissociation constant ($K_d$) of $1 \times 10^{-7}M$ or $1 \times 10^{-8}M$ or less). Affinity constants can be determined by standard kinetic methodology for antibody reactions, for example, immunoassays, surface plasmon resonance (SPR) (Rich and Myszka (2000) Curr. Opin. Biotechnol 11:54; Englebienne (1998) Analyst. 123:1599), isothermal titration calorimetry (ITC) or other kinetic interaction assays known in the art (see, e.g., Paul, ed., Fundamental Immunology, 2nd ed., Raven Press, New York, pages 332-336 (1989); see also U.S. Pat. No. 7,229,619 for a description of exemplary SPR and ITC methods for calculating the binding affinity of anti-RSV antibodies). Instrumentation and methods for real time detection and monitoring of binding rates are known and are commercially available (e.g., BiaCore 2000, Biacore AB, Upsala, Sweden and GE Healthcare Life Sciences; Malmqvist (2000) *Biochem. Soc. Trans.* 27:335).

As used herein, the term "bind selectively" or "selectively binds," in reference to a polypeptide or an antibody provided herein, means that the polypeptide or antibody binds with a selected epitope without substantially binding to another epitope. Typically, an antibody or fragment thereof that selectively binds to a selected epitope specifically binds to the epitope, such as with an affinity constant Ka of about or $1 \times 10^7 M^{-1}$ or $1 \times 10^8 M^{-1}$ or greater.

As used herein, "epitope" refers to the localized region on the surface of an antigen or protein that is recognized by an antibody. Peptide epitopes include those that are continuous epitopes or discontinuous epitopes. An epitope is generally determined by the three dimensional structure of a protein as opposed to the linear amino acid sequence.

As used herein, "binds to the same epitope" with reference to two or more antibodies means that the antibodies compete for binding to an antigen and bind to the same, overlapping or encompassing continuous or discontinuous segments of amino acids. Those of skill in the art understand that the phrase "binds to the same epitope" does not necessarily mean that the antibodies bind to exactly the same amino acids. The precise amino acids to which the antibodies bind can differ. For example, a first antibody can bind to a segment of amino acids that is completely encompassed by the segment of amino acids bound by a second antibody. In another example, a first antibody binds one or more segments of amino acids that significantly overlap the one or more segments bound by the second antibody. For the purposes herein, such antibodies are considered to "bind to the same epitope."

Antibody competition assays can be used to determine whether an antibody "binds to the same epitope" as another antibody. Such assays are well known on the art. Typically, competition of 70% or more, such as 70%, 71%, 72%, 73%, 74%, 75%, 80%, 85%, 90%, 95% or more, of an antibody known to interact with the epitope by a second antibody under conditions in which the second antibody is in excess and the first saturates all sites, is indicative that the antibodies "bind to the same epitope." To assess the level of competition between two antibodies, for example, radioimmunoassays or assays using other labels for the antibodies, can be used. For example, a DLL4 antigen can be incubated with a a saturating amount of a first anti-DLL4 antibody or antigen-binding fragment thereof conjugated to a labeled compound (e.g., $^3H$, $^{125}I$, biotin, or rubidium) in the presence the same amount of a second unlabeled anti-DLL4 antibody. The amount of labeled antibody that is bound to the antigen in the presence of the unlabeled blocking antibody is then assessed and compared to binding in the absence of the unlabeled blocking antibody. Competition is determined by the percentage change in binding signals in the presence of the unlabeled blocking antibody compared to the absence of the blocking antibody. Thus, if there is a 70% inhibition of binding of the labeled antibody in the presence of the blocking antibody compared to binding in the absence of the blocking antibody, then there is competition between the two antibodies of 70%. Thus, reference to competition between a first and second antibody of 70% or more, such as 70%, 71%, 72%, 73%, 74%, 75%, 80%, 85%, 90%, 95% or more, means that the first antibody inhibits binding of the second antibody (or vice versa) to the antigen by 70%, 71%, 72%, 73%, 74%, 75%, 80%, 85%, 90%, 95% or more (compared to binding of the antigen by the second antibody in the absence of the first antibody). Thus, inhibition of binding of a first antibody to an antigen by a second antibody of 70%, 71%, 72%, 73%, 74%, 75%, 80%, 85%, 90%, 95% or more indicates that the two antibodies bind to the same epitope.

As used herein, the term "surface plasmon resonance" refers to an optical phenomenon that allows for the analysis of real-time interactions by detection of alterations in protein concentrations within a biosensor matrix, for example, using the BiaCore system (GE Healthcare Life Sciences).

As used herein, a "bispecific" antibody is a multispecific antibody that contains two or more antigen-binding sites and can immunospecifically bind to two different epitopes. A "trispecific" antibody is a multispecific antibody that contains three or more antigen-binding sites and can immunospecifically bind to three different epitopes, a "tetraspecific" antibody is a multispecific antibody that contains four or more antigen-binding sites and can immunospecifically bind to four different epitopes, and so on.

As used herein, "epitope mapping" is the process of identification of the molecular determinants for antibody-antigen recognition.

As used herein, a "target protein" or "target antigen" refers to candidate proteins or peptides that are specifically recognized by an antibody or portion thereof and/or whose activity is modulated by an antibody or portion thereof. A target protein includes any peptide or protein that contains an epitope for antibody recognition. Target proteins include proteins involved in the etiology of a disease or disorder by virtue of expression or activity. Exemplary target proteins are described herein.

As used herein, a "Hit" refers to an antibody or portion thereof generated, identified, recognized or selected as having an activity for a target antigen. For example, a "Hit" can be identified in a screening assay. Generally, a "Hit" is identified based on its binding activity or affinity for the target antigen. For purposes herein, a "Hit" is generally recognized to be an antibody or portion thereof that has a binding affinity for a target antigen that is at least about or is $10^{-5}$ M, $10^{-6}$ M, $10^{-7}$ M, $10^{-8}$ M, or lower. For purposes herein, a Hit typically is a first antibody or a reference or parent antibody that is further optimized using affinity maturation methods herein. Thus, the terms "Hit", first antibody, reference antibody or parent antibody are used interchangeably herein.

As used herein, a "modified antibody" refers to an antibody, or portion thereof, that contains one ore more amino acid modifications compared to a a parent or reference antibody. An amino acid modification includes an amino acid deletion, replacement (or substitution), or addition. A modified antibody can contain 1, 2, 3, 4, 5, 6, 7, 8, 9, 10, 11, 12, 13, 14, 15, 16, 17, 18, 19, 20 or more amino acid modifications. Typically, an amino acid modification is an amino acid replacement. Generally, the amino acid modifications are present in a region or target region of an antibody, but also can be present in other regions of the antibody or portion thereof.

As used herein, a "related antibody" is an antibody that exhibits structural and functional similarity to a corresponding form of a reference antibody (e.g. a Hit antibody or first antibody), but that does not exhibit the same activity or structure (e.g. sequence) as the reference antibody. For example, a related antibody is one that exhibits sequence simiarlity but is not identical to the reference antibody, and exhibits reduced activity or less activity than the activity of a reference antibody towards a target protein or antigen, such as reduced binding affinity. For purposes herein, an antibody is a related antibody if 1) it exhibits sequence similarity to a reference antibody such that it contains a variable heavy chain and/or a variable light chain that exhibits at least 75% amino acid sequence identity to the corresponding variable heavy chain or variable light chain of the first antibody, where the related antibody (variable heavy chain and variable light chain) does not exhibit 100% sequence identity to the reference antibody; and 2) it exhibits reduced activity compared to a corresponding form of the reference antibody. The sequence similarity or sequence identity can be In another example, an antibody is a related antibody if 1) it exhibits sequence similarity to a reference antibody such that at least one of the $V_H$, $D_H$ and $J_H$ germline segments of the nucleic acid molecule encoding the variable heavy chain of the related antibody is identical to one of the $V_H$, $D_H$ and $J_H$ germline segments of the nucleic acid molecule encoding the variable heavy chain of the first antibody and/or at least one of the $V_\kappa$ and $J_\kappa$ or at least one of the $V_\lambda$ and $J_\lambda$ germline segments of the nucleic acid molecule encoding the variable light chain is identical to one of the $V_\kappa$ and $J_\kappa$ or $V_\lambda$ and $J_\lambda$ germline segments of the nucleic acid molecule encoding the variable light chain of the first antibody; and 2) it exhibits reduced activity compared to a corresponding form of the reference antibody.

As used herein "reduced activity" or "less activity" for a target antigen means that an antibody, or portion thereof, exhibits an activity towards a target antigen (e.g. binding or other functional activity) that is not as high or of the same degree as the activity of a reference antibody for the same target antigen. It is understood that in comparing an activity to a reference antibody, the activity is compared to the corresponding form of the antibody using the same assay to assess activity under the same or similar conditions. Hence, the requisite level of activity between and among two or more antibodies is compared under similar parameters or conditions. For purposes herein, an antibody that has a "reduced activity" or "less activity" for a target antigen generally exhibits 80% or lower the activity towards a target antigen as a reference antibody, such as 5% to 80% of the activity, for example, at or about 80%, 75%, 70%, 60%, 50%, 40%, 30%, 20%, 10%, 5% or lower the activity towards a target antigen as a reference antibody.

As used herein, a "related variable heavy chain" or a "related variable light chain" is one that exhibits sequence identity to the corresponding variable heavy chain and/or variable light chain of a reference antibody, but that is not identical (e.g. does not exhibit 100% sequence identity) to the corresponding variable heavy chain and/or variable light chain of a reference antibody. Generally, a related variable heavy chain or a variable light chain is one that exhibits at least 60% sequence identity to the corresponding chain of the reference antibody, generally at least 75% sequence identity. For example, a related variable heavy chain or a variable light chain is one that exhibits 60% to 99% sequence identity, for example, at or about 60%, 70%, 80%, 85%, 90%, 91%, 92%, 93%, 94%, 95%, 96%, 97%, 98%, or 99% sequence identity to the corresponding chain of the reference antibody. For example, a related antibody includes an antibody in which at least one of the $V_H$, $D_H$ and $J_H$ germline segments of the nucleic acid molecule encoding the variable heavy chain of the related antibody is identical to one of the $V_H$, $D_H$ and $J_H$ germline segments of the nucleic acid molecule encoding the variable heavy chain of the first antibody and/or at least one of the $V_\kappa$ and $J_\kappa$ or at least one of the $V_\lambda$ and $J_\lambda$ germline segments of the nucleic acid molecule encoding the variable light chain is identical to one of the $V_\kappa$ and $J_\kappa$ or $V_\lambda$ and $J_\lambda$ germline segments of the nucleic acid molecule encoding the variable light chain of the first antibody. Generally, a related variable heavy chain and/or variable light chain of an antibody exhibits at least 75% amino acid sequence identity to the corresponding variable heavy chain or variable light of a reference antibody.

As used herein, a form of an antibody refers to a particular structure of an antibody. Antibodies herein include full length antibodies and portions thereof, such as, for example, a Fab fragment or other antibody fragment. Thus, a Fab is a particular form of an antibody.

As used herein, reference to a "corresponding form" of an antibody means that when comparing a property or activity of two antibodies, the property is compared using the same form of the antibody. For example, if its stated that an antibody has less activity compared to the activity of the corresponding form of a first antibody, that means that a particular form, such as a Fab of that antibody, has less activity compared to the Fab form of the first antibody.

As used herein, "sequence diversity" or "sequence similarity" refers to a representation of nucleic acid sequence similarity and is determined using sequence alignments, diversity scores, and/or sequence clustering. Any two sequences can be aligned by laying the sequences side-by-side and analyzing differences within nucleotides at every position along the length of the sequences. Sequence alignment can be assessed in silico using Basic Local Alignment Search Tool (BLAST), an NCBI tool for comparing nucleic acid and/or protein sequences. The use of BLAST for sequence alignment is well known to one of skill in the art. The Blast search algorithm compares two sequences and calculates the statistical significance of each match (a Blast score). Sequences that are most similar to each other will have a high Blast score, whereas sequences that are most varied will have a low Blast score.

As used herein, Basic Local Alignment Search Tool (BLAST) is a search algorithm developed by Altschul et al. (1990) to separately search protein or DNA databases, for example, based on sequence identity. For example, blastn is a program that compares a nucleotide query sequence against a nucleotide sequence database (e.g. GenBank). BlastP is a program that compares an amino acid query sequence against a protein sequence database.

As used herein, a "target region" refers to a region of a variable heavy chain or variable light chain of an antibody (e.g. a Hit antibody) or portion thereof that exhibits at least one amino acid differences compared to the corresponding region of related antibody or antibodies. Thus, a target region includes one or more of a CDR1, CDR2, CDR3, FR1, FR2, FR3 or FR4 of the variable heavy chain or variable light chain of a an antibody that contains at least one amino acid difference compared to the corresponding region of a related antibody. Generally, a target region is a region of an antibody that is associated with the structure/activity relationship (SAR) of the antibody. Thus, for purposes of practice of the method herein, a target region is one that is targeted for further mutagenesis. As described herein, it is within the level of one of skill in the art to identify such regions and to determine if amino acid differences exist. One of skill in the art knows and can identify a region in an antibody, for example a CDR or FR, based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917).

As used herein, "saturation mutagenesis" refers to the process of systematically generating a plurality of mutants by replacing at least one amino acid residue of a protein sequence to all or a subset of the remaining amino acid residues or to effect replacement of a number of amino acid residues (within or across the full length of the protein or within or across a region of a protein) each to all or a subset of the remaining amino acid residues. Saturation mutagenesis can be full or partial.

As used herein, "full saturation mutagenesis" refers to the process of systematically generating a plurality of mutants by replacing an amino acid residue in a protein sequence with the other 19 other naturally-occurring amino acids. A single amino acid residue in a protein sequence can be subject to mutagenesis. Alternatively, all or a subset of amino acid residues across the full length sequence of a protein or a region of the protein sequence (e.g. target region) can be subjected to full saturation mutagenesis.

As used herein, "partial saturation mutagenesis" refers to the process of systematically generating a plurality of mutant sequences by replacing an amino acid residue in a protein sequence to a subset of the other 19 other naturally-occurring amino acids. A single amino acid residue in a protein sequence can be subject to mutagenesis. Alternatively, all or a subset of amino acid residues across the full length sequence of a protein or a region of the protein sequence (e.g. target region) can be subjected to partial saturation mutagenesis.

As used herein, "scanning mutagenesis" refers to the process of systematically replacing all or a subset of amino acids in a protein or in a region of a protein (e.g. target region) with a selected amino acid, typically alanine, glycine or serine, as long as each residue is replaced with the same residue. Typically, the replacing amino acid is an alanine. As used herein, reference to an antibody that is an "Up mutant" or an antibody that "exhibits retained or increased activity", refers to an antibody subjected to scanning mutagenesis whose activity when containing a single amino acid mutation to a scanned amino acid is retained or increased compared to the parent antibody not contained the scanned amino acid mutation. The antibody that retains an activity to a target antigen can exhibit some increase or decrease in binding, but generally exhibits the same binding as the first antibody not containing the scanned mutation, for example, exhibits at least 75% of the binding activity, such as 75% to 120% of the binding, for example, 75%, 80%, 85%, 90%, 95%, 100%, 105%, 110% or 115% of the binding. An antibody that exhibits increased activity to a target antigen generally exhibits greater than 115% of the activity, such as greater than 115%, 120%, 130%, 140%, 150%, 200% or more activity than the first antibody not containing the mutation.

As used herein "iterative" with respect to performing the steps of the method means that the method is repeated a plurality of times, such as 2, 3, 4, 5 or more times, until a modified "Hit" is identified whose activity is optimized or improved compared to prior iterations.

As used herein, an "intermediate" with reference to an antibody or portion thereof refers to an antibody that is derived from or evolved from a reference antibody, template or parent antibody, for example, by the process of affinity maturation, but that is itself further evolved. For example, once a modified Hit is selected in the affinity maturation method herein, it can itself be used as a template in order to further evolve or optimize the antibody. Hence, the modified Hit is an intermediate antibody in order to identify or select a further modified Hit.

As used herein, an "antibody library" refers to a collection of antibody members or portions thereof, for example, 2 or more, typically 5 or more, and typically 10 or more, such as, for example, at or about 10, 15, 20, 30, 40, 50, 60, 70, 80, 90, 100, 200, 300, 400, 500, 1000, $10^4$, $10^5$, $10^6$, $10^7$, $10^8$, $10^9$, $10^{10}$, $10^{11}$, $10^{12}$, $10^{13}$, $10^{14}$ or more of such molecules. In some examples, the members of the collection are analogous to each other in that members within a collection are varied compared to a target or template antibody. An antibody library, however, encompasses a collection of any antibody members, or portions thereof. Thus, it is not necessary that each member within the collection is varied compared to a template member. Generally, collections contain different members (i.e. based on sequence), although in some cases collections of antibodies can contain some members that are the same. Typically, collections contain at least $10^4$ or about $10^4$, $10^5$ or about $10^5$, $10^6$ or about $10^6$, at least $10^8$ or about $10^8$, at least $10^9$ or about $10^9$, at least $10^{10}$ or about $10^{10}$, or more different antibody members. Thus, the collections typically have a diversity of at least $10^4$ or about $10^4$, $10^5$ or about $10^5$, $10^6$ or about $10^6$, at least $10^8$ or about $10^8$, at least $10^9$ or about $10^9$, at least $10^{10}$ or about $10^{10}$, at least $10^{11}$ or about $10^{11}$, at least $10^{12}$ or about $10^{12}$, at least $10^{13}$ or about $10^{13}$, at least $10^{14}$ or about $10^{14}$, or more. Thus, an antibody library having a diversity of $10^7$ means that it contains $10^7$ different members.

As used herein, "diversity" with respect to members in a collection or library refers to the number of unique members in a collection. Hence, diversity refers to the number of different amino acid sequences or nucleic acid sequences, respectively, among the analogous polypeptide members of that collection. For example, a collection of polynucleotides having a diversity of $10^4$ contains $10^4$ different nucleic acid sequences among the analogous polynucleotide members. In one example, the provided collections of polynucleotides and/or polypeptides have diversities of at least at or about $10^2$, $10^3$, $10^4$, $10^5$, $10^6$, $10^7$, $10^8$, $10^9$, $10^{10}$ or more.

As used herein, "a diversity ratio" refers to a ratio of the number of different members in the library over the number of total members of the library. Thus, a library with a larger diversity ratio than another library contains more different members per total members, and thus more diversity per total members. The provided libraries include libraries having high diversity ratios, such as diversity ratios approaching 1, such as, for example, at or about 0.1, 0.2, 0.3, 0.4, 0.5, 0.6, 0.7, 0.8, 0.9 0.91, 0.92, 0.93, 0.94, 0.95. 0.96, 0.97, 0.98, or 0.99.

As used herein, "combinatorial library" refers to collections of compounds formed by reacting different combinations of interchangeable chemical "building blocks" to produce a collection of compounds based on permutations of the building blocks. For an antibody combinatorial library, the building blocks are the component V, D and J regions (or modified forms thereof) from which antibodies are formed. For purposes herein, the terms "library" or "collection" are used interchangeably.

As used herein, a combinatorial antibody library is a collection of antibodies (or portions thereof, such as Fabs), where the antibodies are encoded by nucleic acid molecules produced by the combination of V, D and J gene segments, particularly human V, D and J germline segments. The combinatorial libraries herein typically contain at least 50 different antibody (or antibody portions or fragment) members, typically at least or about 50 to $10^{10}$ or more different members, generally at least or about $10^2$ to $10^6$ or more different members, for example, at least or about 50, 100, 500, $10^3$, $1 \times 10^3$, $2 \times 10^3$, $3 \times 10^3$, $4 \times 10^3$, $5 \times 10^3$, $6 \times 10^3$, $7 \times 10^3$ $10^4$, $1 \times 10^5$, $2 \times 10^5$, $3 \times 10^5$, $4 \times 10^5$, $5 \times 10^5$, $6 \times 10^5$, $7 \times 10^5$, $8 \times 10^5$, $9 \times 10^5$, $10^6$, $10^7$, $10^8$, $10^9$, $10^{10}$, or more different members. The resulting libraries or collections of antibodies or portions thereof, can be screened for binding to a target protein or modulation of a functional activity.

As used herein, a human combinatorial antibody library is a collection of antibodies or portions thereof, whereby each member contains a VL and VH chains or a sufficient portion thereof to form an antigen binding site encoded by nucleic acid containing human germline segments produced as described in U.S. Provisional Application Nos. 61/198,764 and 61/211,204, incorporated by reference herein.

As used herein, a locus in a library refers to a location or position, that can contain a member or members of library. The position does not have to be a physical position. For example, if the collection is provided as an array on a solid support, the support contains loci that can or do present members of the array.

As used herein, an address refers to a unique identifier for each locus in a collection whereby an addressed member (e.g. an antibody) can be identified. An addressed moiety is one that can be identified by virtue of its locus or location. Addressing can be effected by position on a surface, such as a well of a microplate. For example, an address for a protein in a microwell plate that is F9 means that the protein is located in row F, column 9 of the microwell plate. Addressing also can be effected by other identifiers, such as a tag encoded with a bar code or other symbology, a chemical tag, an electronic, such RF tag, a color-coded tag or other such identifier.

As used herein, an array refers to a collection of elements, such as antibodies, containing three or more members.

As used herein, a "spatial array" is an array where members are separated or occupy a distinct space in an array. Hence, spatial arrays are a type of addressable array. Examples of spatial arrays include microtiter plates where each well of a plate is an address in the array. Spacial arrays include any arrangement wherein a plurality of different molecules, e.g, polypeptides, are held, presented, positioned, situated, or supported. Arrays can include microtiter plates, such as 48-well, 96-well, 144-well, 192-well, 240-well, 288-well, 336-well, 384-well, 432-well, 480-well, 576-well, 672-well, 768-well, 864-well, 960-well, 1056-well, 1152-well, 1248-well, 1344-well, 1440-well, or 1536-well plates, tubes, slides, chips, flasks, or any other suitable laboratory apparatus. Furthermore, arrays can also include a plurality of sub-arrays. A plurality of sub-arrays encompasses an array where more than one arrangement is used to position the polypeptides. For example, multiple 96-well plates can constitute a plurality of sub-arrays and a single array.

As used herein, an addressable library is a collection of molecules such as nucleic acid molecules or protein agents, such as antibodies, in which each member of the collection is identifiable by virtue of its address.

As used herein, an addressable array is one in which the members of the array are identifiable by their address, the position in a spatial array, such as a well of a microtiter plate, or on a solid phase support, or by virtue of an identifiable or detectable label, such as by color, fluorescence, electronic signal (i.e. RF, microwave or other frequency that does not substantially alter the interaction of the molecules of interest), bar code or other symbology, chemical or other such label. Hence, in general the members of the array are located at identifiable loci on the surface of a solid phase or directly or indirectly linked to or otherwise associated with the identifiable label, such as affixed to a microsphere or other particulate support (herein referred to as beads) and suspended in solution or spread out on a surface. As used herein, "an addressable antibody library" or "an addressable combinatorial antibody library" refers to a collection of antibodies in which member antibodies are identifiable and all antibodies with the same identifier, such as position in a spatial array or on a solid support, or a chemical or RF tag, bind to the same antigen, and generally are substantially the same in amino acid sequence. For purposes herein, reference to an "addressable arrayed combinatorial antibody library" means that the antibody members are addressed in an array.

As used herein, a support (also referred to as a matrix support, a matrix, an insoluble support or solid support) refers to any solid or semisolid or insoluble support to which a molecule of interest, typically a biological molecule, organic molecule or biospecific ligand is linked or contacted. Such materials include any materials that are used as affinity matrices or supports for chemical and biological molecule syntheses and analyses, such as, but are not limited to: polystyrene, polycarbonate, polypropylene, nylon, glass, dextran, chitin, sand, pumice, agarose, polysaccharides, dendrimers, buckyballs, polyacrylamide, silicon, rubber, and other materials used as supports for solid phase syntheses, affinity separations and purifications, hybridization reactions, immunoassays and other such applications. The matrix herein can be particulate or can be in the form of a continuous surface, such as a microtiter dish or well, a glass slide, a silicon chip, a nitrocellulose sheet, nylon mesh, or other such materials. When particulate, typically the particles have at least one dimension in the 5-10 mm range or smaller. Such particles, referred collectively herein as "beads", are often, but not necessarily, spherical. Such reference, however, does not constrain the geometry of the matrix, which can be any shape, including random shapes, needles, fibers, and elongated. Roughly spherical "beads", particularly microspheres that can be used in the liquid phase, also are contemplated. The "beads" can include additional components, such as magnetic or paramagnetic particles (see, e.g., Dynabeads® (Dynal, Oslo, Norway)) for separation using magnets, as long as the additional components do not interfere with the methods and analyses herein.

As used herein, matrix or support particles refers to matrix materials that are in the form of discrete particles. The particles have any shape and dimensions, but typically have at least one dimension that is 100 mm or less, 50 mm or less, 10 mm or less, 1 mm or less, 100 μm or less, 50 μm or less and typically have a size that is 100 mm$^3$ or less, 50 mm$^3$ or less, 10 mm$^3$ or less, and 1 mm$^3$ or less, 100 μm$^3$ or less and can be on the order of cubic microns. Such particles are collectively called "beads."

As used herein, germline gene segments refer to immunoglobulin (Ig) variable (V), diversity (D) and junction (J) or constant (C) genes from the germline that encode immunoglobulin heavy or light (kappa and lambda) chains. There are multiple V, D, J and C gene segments in the germline, but gene rearrangement results in only one segment of each occurring in each functional rearranged gene. For example, a functionally rearranged heavy chain contains one V, one D and one J and a functionally rearranged light chain gene contains one V and one J. Hence, these gene segments are carried in the germ cells but cannot be transcribed and translated into heavy and light chains until they are arranged into functional genes. During B-cell differentiation in the bone marrow, these gene segments are randomly shuffled by a dynamic genetic system capable of generating more than $10^{10}$ specificities.

For purposes herein, heavy chain germline segments are designated as $V_H$, $D_H$ and $J_H$, and compilation thereof results in a nucleic acid encoding a VH chain. Light chain germline segments are designated as $V_L$ or $J_L$, and include kappa and lambda light chains ($V_\kappa$ and $J_\kappa$; $V_\lambda$ and $J_\lambda$) and compilation thereof results in a nucleic acid encoding a VL chain. It is understood that a light chain chain is either a kappa or lambda light chain, but does not include a kappa/lambda combination by virtue of compilation of a $V_\kappa$ and $J_\lambda$.

Reference to a variable germline segment herein refers to V, D and J groups, subgroups, genes or alleles thereof. Gene segment sequences are accessible from known database (e.g., National Center for Biotechnology Information (NCBI), the international ImMunoGeneTics information System® (IMGT), the Kabat database and the Tomlinson's VBase database (Lefranc (2003) *Nucleic Acids Res.*, 31:307-310; Martin et al., Bioinformatics Tools for Antibody Engineering in Handbook of Therapeutic Antibodies, Wiley-VCH (2007), pp. 104-107).

As used herein, a "group" with reference to a germline segment refers to a core coding region from an immunoglobulin, i.e. a variable (V) gene, diversity (D) gene, joining (J) gene or constant (C) gene encoding a heavy or light chain. Exemplary of germline segment groups include $V_H$, $D_H$, $J_H$, $V_\kappa$, $J_\kappa$, $V_\lambda$, and $J_\lambda$.

As used herein, a "subgroup" with reference to a germline segment refers to a set of sequences that are defined by nucleotide sequence similarity or identity. Generally, a subgroup is a set of genes that belong to the same group [V, D, J or C], in a given species, and that share at least 75% identity at the nucleotide level. Subgroups are classified based on IMGT nomenclature (imgt.cines.fr; see e.g., Lefranc et al. (2008) Briefings in Bioinformatics, 9:263-275). Generally, a subgroup represent a multigene family.

As used herein, an allele of a gene refer to germline sequences that have sequence polymorphism due to one or more nucleotide differences in the coding region compared to a reference gene sequence (e.g. substitutions, insertions or deletions). Thus, IG sequences that belong to the same subgroup can be highly similar in their coding sequence, but nonetheless exhibit high polymorphism. Subgroup alleles are classified based on IMGT nomenclature with an asterisk (*) followed by a two figure number.

As used herein, a "family" with reference to a germline segment refers to sets of germline segment sequences that are defined by amino acid sequence similarity or identity. Generally, a germline family includes all alleles of a gene.

As used herein, inverted sequence with reference to nucleotides of a germline segment means that the gene segment has a sequence of nucleotides that is the reverse complement of a reference sequence of nucleotides.

As used herein, "compilation," "compile," "combine," "combination," "rearrange," "rearrangement," or other similar terms or grammatical variations thereof refers to the process by which germline segments are ordered or assembled into nucleic acid sequences representing genes. For example, in the combinatorial method, variable heavy chain germline segments are assembled such that the $V_H$ segment is 5' to the $D_H$ segment which is 5' to the $J_H$ segment, thereby resulting in a nucleic acid sequence encoding a VH chain. Variable light chain germline segments are assembled such that the $V_L$ segment is 5' to the $J_L$ segment, thereby resulting in a nucleic acid sequence encoding a VL chain. A constant gene segment or segments also can be assembled onto the 3' end of a nucleic acid encoding a VH or VL chain.

As used herein, "linked," or "linkage" or other grammatical variations thereof with reference to germline segments refers to the joining of germline segments. Linkage can be direct or indirect. Germline segments can be linked directly without additional nucleotides between segments, or additional nucleotides can be added to render the entire segment in-frame, or nucleotides can be deleted to render the resulting segment in-frame. In the method of generating a combinatorial antibody library, it is understood that the choice of linker nucleotides is made such that the resulting nucleic acid molecule is in-frame and encodes a functional and productive antibody.

As used herein, "in-frame" or "linked in-frame" with reference to linkage of human germline segments means that there are insertions and/or deletions in the nucleotide germline segments at the joined junctions to render the resulting nucleic acid molecule in-frame with the 5' start codon (ATG), thereby producing a "productive" or functional full-length polypeptide. The choice of nucleotides inserted or deleted from germline segments, particularly at joints joining various VD, DJ and VJ segments, is in accord with the rules provided in the method herein for V(D)J joint generation described in detail in U.S. Provisional Application Nos. 61/198,764 and 61/211,204. For example, germline segments are assembled such that the $V_H$ segment is 5' to the $D_H$ segment which is 5' to the $J_H$ segment. At the junction joining the $V_H$ and the $D_H$ and at the junction joining the $D_H$ and $J_H$ segments, nucleotides can be inserted or deleted from the individual $V_H$, $D_H$ or $J_H$ segments, such that the resulting nucleic acid molecule containing the joined VDJ segments are in-frame with the 5' start codon (ATG).

As used herein, a "functional antibody" or "productive antibody" with reference to a nucleic acid encoding an antibody or portion thereof refers to an antibody or portion thereof, such as Fab, that is encoded by the nucleic acid molecule produced by the combinatorial method. In a functional or productive antibody, the V(D)J germline segments are compiled (i.e. rearranged) such that the encoded antibody or portion thereof is not truncated and/or the amino acid sequence is not out of frame. This means that the nucleic acid molecule does not contain internal stop codons that result in the protein translation machinery terminating protein assembly prematurely.

As used herein, corresponding with reference to corresponding residues, for example "amino acid residues corresponding to", refers to residues compared among or between two polypeptides that are related sequences (e.g. allelic variants, genes of the same family, species variants). One of skill in the art can readily identify residues that correspond between or among polypeptides. For example, by aligning two sequences, one of skill in the art can identify corresponding residues, using conserved and identical amino acids as guides. One of skill in the art can manually align a sequence or can use any of the numerous alignment programs available (for example, BLAST). Hence, an amino acid residues or positions that correspond to each other are those residues that are determined to correspond to one another based on sequence and/or structural alignments with a specified reference polypeptide.

As used herein, "screening" refers to identification or selection of an antibody or portion thereof from a plurality of antibodies, such as a collection or library of antibodies and/or portions thereof, based on determination of the activity or property of an antibody or portion thereof. Screening can be performed in any of a variety of ways, including, for example, by assays assessing direct binding (e.g. binding affinity) of the antibody to a target protein or by functional assays assessing modulation of an activity of a target protein.

As used herein the term assessing is intended to include quantitative and qualitative determination in the sense of obtaining an absolute value for the binding of an antibody or portion thereof with a target protein and/or modulation of an activity of a target protein by an antibody or portion thereof, and also of obtaining an index, ratio, percentage, visual or other value indicative of the level of the binding or activity. Assessment can be direct or indirect. For example, binding can be determined by directly labeling of an antibody or portion thereof with a detectable label and/or by using a secondary antibody that itself is labeled. In addition, functional activities can be determined using any of a variety of assays known to one of skill in the art, for example, proliferation, cytotoxicity and others as described herein, and comparing the activity of the target protein in the presence versus the absence of an antibody or portion thereof.

As used herein, "modulate" or "modulation" and other various grammatical forms thereof with reference to the effect of an antibody or portion thereof on the functional activity of a target protein refers to increased activity such as induction or potentiation of activity, as well as inhibition of one or more activities of the target protein. Hence, modulation can include an increase in the activity (i.e., up-regulation or agonist activity) a decrease in activity (i.e., down-regulation or inhibition) or any other alteration in an activity (such as a change in periodicity, frequency, duration, kinetics or other parameter). Modulation can be context dependent and typically modulation is compared to a designated state, for example, the wildtype protein, the protein in a constitutive state, or the protein as expressed in a designated cell type or condition. The functional activity of a target protein by an antibody or portion thereof can be modulated by 10%, 20%, 30%, 40%, 50%, 60%, 70%, 80%, 90% or more compared to the activity of the target protein in the abasence of the antibody or portion thereof.

As used herein, Delta-like 4 (DLL4) refers to a protein that is a ligand for Notch receptors 1 and 4. DLL4 includes any DLL4 polypeptide, including but not limited to, a recombinantly produced polypeptide, a sythentically produced polypeptide, a native DLL4 polypeptide, and a DLL4 polypeptide extracted from cells or tissues, including endothelial cells. DLL4 also includes related polypeptides from different species including, but not limited to animals of human and non-human origin. Human DLL4 includes DLL4, allelic variant isoforms, synthetic molecules from nucleic acids, protein isolated from human tissue and cells, and modified forms thereof. An exemplary DLL4 includes human DLL4 having a sequence of amino acids set forth in SEQ ID NO:2904 and encoded by a sequence of nucleotides set forth in SEQ ID NO:2905. For purposes herein, reference to DLL4 is typically with reference to human DLL4, unless stated otherwise.

As used herein, an "activator", such as an "agonist" or "activator/modulator," refers to an antibody or portion thereof that modulates signal transduction or other functional activity of a receptor by potentiating, inducing or otherwise enhancing the signal transduction activity or other functional activity of a receptor. An activator, such as an agonists or activator/modulator, can modulate or increase signal transduction or other functional activity when used alone or can alter signal transduction or other functional activity in the presence of the natural ligand of the receptor or other receptor stimulator to enhance signaling by the receptor compared to the ligand alone. An activator includes an agonist or activator/modulator.

As used herein, an "agonist" refers to an antibody or portion thereof that mimics the activity of an endogenous ligand, and can replace the endogenous ligand.

As used herein, a "modulator/activator" refers to an antibody or portion thereof that binds an allosteric site of a target substrate and alters, such as increases, the activation of a receptor by its ligand.

As used herein, an "allosteric site" is a site on the target substrate that is not the site conferring ligand/receptor interaction, but that when bound by an antibody or a portion thereof alters the activity of the target substrate.

As used herein, "antagonist" refers to an antibody or portion thereof that modulates signal transduction or other functional activity of a receptor by blocking or decreasing the signal transduction activity or other functional activity of a receptor.

As used herein, off-rate ($k_{off}$) is the rate at which an antibody dissociates from its antigen.

As used herein, on-rate ($k_{on}$) is the rate at which an antibody binds antigen.

As used herein, "half-life" ($t_{1/2}$) or "dissociation half-life" refers to the time in which half of the initially present protein-ligand or substrate-antibody complexes have disassociated. It is designated as $Ln(2)/k_{off}$.

As used herein, reference to an "antibody or portion thereof that is sufficient to form an antigen binding site" means that the antibody or portion thereof contains at least 1 or 2, typically 3, 4, 5 or all 6 CDRs of the VH and VL sufficient to retain at least a portion of the binding specificity of the corresponding full-length antibody containing all 6 CDRs. Generally, a sufficient antigen binding site at least requires CDR3 of the heavy chain (CDRH3). It typically further requires the CDR3 of the light chain (CDRL3). As described herein, one of skill in the art knows and can identify the CDRs based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). For example, based on Kabat numbering, CDR-L1 corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H102.

As used herein, a label is a detectable marker that can be attached or linked directly or indirectly to a molecule or associated therewith. The detection method can be any method known in the art.

As used herein, a human protein is one encoded by a nucleic acid molecule, such as DNA, present in the genome of a human, including all allelic variants and conservative variations thereof. A variant or modification of a protein is a human protein if the modification is based on the wildtype or prominent sequence of a human protein.

As used herein, "naturally occurring amino acids" refer to the 20 L-amino acids that occur in polypeptides. The residues are those 20 α-amino acids found in nature which are incorporated into protein by the specific recognition of the charged tRNA molecule with its cognate mRNA codon in humans.

As used herein, non-naturally occurring amino acids refer to amino acids that are not genetically encoded. For example, a non-natural amino acid is an organic compound that has a structure similar to a natural amino acid but has been modified structurally to mimic the structure and reactivity of a natural amino acid. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art.

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids which occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |

TABLE 1-continued

Table of Correspondence

| SYMBOL | | |
|---|---|---|
| 1-Letter | 3-Letter | AMINO ACID |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH. The abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726). Each naturally occurring L-amino acid is identified by the standard three letter code (or single letter code) or the standard three letter code (or single letter code) with the prefix "L-"; the prefix "D-" indicates that the stereoisomeric form of the amino acid is D.

As used herein, an isokinetic mixture is one in which the molar ratios of amino acids has been adjusted based on their reported reaction rates (see, e.g., Ostresh et al., (1994) *Biopolymers* 34:1681).

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. co., p. 224). Such substitutions can be made in accordance with those set forth in TABLE 2 as follows:

TABLE 2

| Original residue | Exemplary conservative substitution |
|---|---|
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term "nucleic acid" refers to single-stranded and/or double-stranded polynucleotides such as deoxyribonucleic acid (DNA), and ribonucleic acid (RNA) as well as analogs or derivatives of either RNA or DNA. Also included in the term "nucleic acid" are analogs of nucleic acids such as peptide nucleic acid (PNA), phosphorothioate DNA, and other such analogs and derivatives or combinations thereof. Nucleic acid can refer to polynucleotides such as deoxyribonucleic acid (DNA) and ribonucleic acid (RNA). The term also includes, as equivalents, derivatives, variants and analogs of either RNA or DNA made from nucleotide analogs, single (sense or antisense) and double-stranded polynucleotides. Deoxyribonucleotides include deoxyadenosine, deoxycytidine, deoxyguanosine and deoxythymidine. For RNA, the uracil base is uridine.

As used herein, "nucleic acid molecule encoding" refers to a nucleic acid molecule which directs the expression of a specific protein or peptide. The nucleic acid sequences include both the DNA strand sequence that is transcribed into RNA and the RNA sequence that is translated into protein or peptide. The nucleic acid molecule includes both the full length nucleic acid sequences as well as non-full length sequences derived from the full length mature polypeptide, such as for example a full length polypeptide lacking a precursor sequence. For purposes herein, a nucleic acid sequence also includes the degenerate codons of the native sequence or sequences which can be introduced to provide codon preference in a specific host.

As used herein, the term "polynucleotide" refers to an oligomer or polymer containing at least two linked nucleotides or nucleotide derivatives, including a deoxyribonucleic acid (DNA), a ribonucleic acid (RNA), and a DNA or RNA derivative containing, for example, a nucleotide analog or a "backbone" bond other than a phosphodiester bond, for example, a phosphotriester bond, a phosphoramidate bond, a phophorothioate bond, a thioester bond, or a peptide bond (peptide nucleic acid). The term "oligonucleotide" also is used herein essentially synonymously with "polynucleotide," although those in the art recognize that oligonucleotides, for example, PCR primers, generally are less than about fifty to one hundred nucleotides in length.

Polynucleotides can include nucleotide analogs, including, for example, mass modified nucleotides, which allow for mass differentiation of polynucleotides; nucleotides containing a detectable label such as a fluorescent, radioactive, luminescent or chemiluminescent label, which allow for detection of a polynucleotide; or nucleotides containing a reactive group such as biotin or a thiol group, which facilitates immobilization of a polynucleotide to a solid support. A polynucleotide also can contain one or more backbone bonds that are selectively cleavable, for example, chemically, enzymatically or photolytically. For example, a polynucleotide can include one or more deoxyribonucleotides, followed by one or more ribonucleotides, which can be followed by one or more deoxyribonucleotides, such a sequence being cleavable at the ribonucleotide sequence by base hydrolysis. A polynucleotide also can contain one or more bonds that are relatively resistant to cleavage, for example, a chimeric oligonucleotide primer, which can include nucleotides linked by peptide nucleic acid bonds and at least one nucleotide at the 3' end, which is linked by a phosphodiester bond or other suitable bond, and is capable of being extended by a polymerase. Peptide nucleic acid sequences can be prepared using well-known methods (see, for example, Weiler et al. Nucleic acids Res. 25: 2792-2799 (1997)).

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

"Identity" per se has an art-recognized meaning and can be calculated using published techniques. (See, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991). While there exists a number of methods to measure identity between two polynucleotide or polypeptides, the term "identity" is well known to skilled artisans (Carillo, H. & Lipton, D., *SIAM J Applied Math* 48:1073 (1988)).

As used herein, homologous (with respect to nucleic acid and/or amino acid sequences) means about greater than or equal to 25% sequence homology, typically greater than or equal to 25%, 40%, 50%, 60%, 70%, 80%, 85%, 90% or 95% sequence homology; the precise percentage can be specified if necessary. For purposes herein the terms "homology" and "identity" are often used interchangeably, unless otherwise indicated. In general, for determination of the percentage homology or identity, sequences are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073). By sequence homology, the number of conserved amino acids is determined by standard alignment algorithms programs, and can be used with default gap penalties established by each supplier. Substantially homologous nucleic acid molecules hybridize typically at moderate stringency or at high stringency all along the length of the nucleic acid of interest. Also contemplated are nucleic acid molecules that contain degenerate codons in place of codons in the hybridizing nucleic acid molecule.

Whether any two molecules have nucleotide sequences or amino acid sequences that are at least 60%, 70%, 80%, 85%, 90%, 95%, 96%, 97%, 98% or 99% "identical" or "homologous" can be determined using known computer algorithms such as the "FASTA" program, using for example, the default parameters as in Pearson et al. (1988) *Proc. Natl. Acad. Sci. USA* 85:2444 (other programs include the GCG program package (Devereux, J., et al., *Nucleic Acids Research* 12(I):387 (1984)), BLASTP, BLASTN, FASTA (Atschul, S. F., et al., *J Molec Biol* 215:403 (1990)); Guide to Huge Computers, Martin J. Bishop, ed., Academic Press, San Diego, 1994, and Carillo et al. (1988) *SIAM J Applied Math* 48:1073). For example, the BLAST function of the National Center for Biotechnology Information database can be used to determine identity. Other commercially or publicly available programs include, DNAStar "MegAlign" program (Madison, Wis.) and the University of Wisconsin Genetics Computer Group (UWG) "Gap" program (Madison Wis.). Percent homology or identity of proteins and/or nucleic acid molecules can be determined, for example, by comparing sequence information using a GAP computer program (e.g., Needleman et al. (1970) *J. Mol. Biol.* 48:443, as revised by Smith and Waterman ((1981) *Adv. Appl. Math.* 2:482). Briefly, the GAP program defines similarity as the number of aligned symbols (i.e., nucleotides or amino acids), which are similar, divided by the total number of symbols in the shorter of the two sequences. Default parameters for the GAP program can include: (1) a unary comparison matrix (containing a value of 1 for identities and 0 for non-identities) and the weighted comparison matrix of Gribskov et al. (1986) *Nucl. Acids Res.* 14:6745, as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" or "homology" represents a comparison between a test and a reference polypeptide or polynucleotide. As used herein, the term at least "90% identical to" refers to percent identities from 90 to 99.99 relative to the reference nucleic acid or amino acid sequence of the polypeptide. Identity at a level of 90% or more is indicative of the fact that, assuming for exemplification purposes a test and reference polypeptide length of 100 amino acids are compared. No more than 10% (i.e., 10 out of 100) of the amino acids in the test polypeptide differs from that of the reference polypeptide. Similar comparisons can be made between test and reference polynucleotides. Such differences can be represented as point mutations randomly distributed over the entire length of a polypeptide or they can be clustered in one or more locations of varying length up to the maximum allowable, e.g. 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often by manual alignment without relying on software.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that a certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50°

C. Equivalent stringency conditions are known in the art. The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wildtype form and/or predominant form of a polypeptide from a population or single reference member of a species. Typically, allelic variants, which include variants between and among species typically have at least 80%, 90% or greater amino acid identity with a wildtype and/or predominant form from the same species; the degree of identity depends upon the gene and whether comparison is interspecies or intraspecies. Generally, intraspecies allelic variants have at least about 80%, 85%, 90% or 95% identity or greater with a wildtype and/or predominant form, including 96%, 97%, 98%, 99% or greater identity with a wildtype and/or predominant form of a polypeptide. Reference to an allelic variant herein generally refers to variations n proteins among members of the same species.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human.

As used herein, a splice variant refers to a variant produced by differential processing of a primary transcript of genomic DNA that results in more than one type of mRNA.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell or tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification does not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than about or at 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight) 20%, 10%, 5% or less of chemical precursors or non-protease chemicals or components.

As used herein, synthetic, with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, production by recombinant means by using recombinant DNA methods means the use of the well known methods of molecular biology for expressing proteins encoded by cloned DNA.

As used herein, vector (or plasmid) refers to discrete elements that are used to introduce a heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well known to those of skill in the art.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, operably or operatively linked when referring to DNA segments means that the segments are arranged so that they function in concert for their intended purposes, e.g., transcription initiates in the promoter and proceeds through the coding segment to the terminator.

As used herein, biological sample refers to any sample obtained from a living or viral source and includes any cell type or tissue of a subject from which nucleic acid or protein or other macromolecule can be obtained. Biological samples include, but are not limited to, body fluids, such as blood, plasma, serum, cerebrospinal fluid, synovial fluid, urine and sweat, tissue and organ samples from animals and plants. Also included are soil and water samples and other environmental samples, viruses, bacteria, fungi, algae, protozoa and components thereof. Hence bacterial and viral and other contamination of food products and environments can be assessed. The methods herein are practiced using biological samples and in some embodiments, such as for profiling, also can be used for testing any sample.

As used herein, macromolecule refers to any molecule having a molecular weight from the hundreds up to the millions. Macromolecules include peptides, proteins, nucleotides, nucleic acids, and other such molecules that are generally synthesized by biological organisms, but can be prepared synthetically or using recombinant molecular biology methods.

As used herein, a composition refers to any mixture. It can be a solution, a suspension, liquid, powder, a paste, aqueous, non-aqueous or any combination thereof.

As used herein, a combination refers to any association between or among two or more items. The combination can be two or more separate items, such as two compositions or two collections, can be a mixture thereof, such as a single mixture of the two or more items, or any variation thereof.

As used herein, kit refers to a packaged combination, optionally including instructions and/or reagents for their use.

As used herein, a pharmaceutical effect or therapeutic effect refers to an effect observed upon administration of an agent intended for treatment of a disease or disorder or for amelioration of the symptoms thereof.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving a specific target protein including those mediated by a target protein and those in which a target protein plays a role in the etiology or pathology. Exemplary target proteins and associated diseases and disorders are described elsewhere herein.

As used herein, angiogenic diseases (or angiogenesis-related diseases) are diseases in which the balance of angiogenesis is altered or the timing thereof is altered. Angiogenic diseases include those in which an alteration of angiogenesis, such as undesirable vascularization, occurs. Such diseases include, but are not limited to cell proliferative disorders, including cancers, diabetic retinopathies and other diabetic complications, inflammatory diseases, endometriosis, age-related macular degeneration and other diseases in which excessive vascularization is part of the disease process, including those known in the art or noted elsewhere herein.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified interferon and compositions provided herein.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease or other indication, are ameliorated or otherwise beneficially altered.

As used herein therapeutic effect means an effect resulting from treatment of a subject that alters, typically improves or ameliorates the symptoms of a disease or condition or that cures a disease or condition. A therapeutically effective amount refers to the amount of a composition, molecule or compound which results in a therapeutic effect following administration to a subject.

As used herein, the term "subject" refers to an animal, including a mammal, such as a human being.

As used herein, a patient refers to a human subject.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced.

As used herein, an effective amount is the quantity of a therapeutic agent necessary for preventing, curing, ameliorating, arresting or partially arresting a symptom of a disease or disorder.

As used herein, administration refers to any method in which an antibody or portion thereof is contacted with its target protein. Administration can be effected in vivo or ex vivo or in vitro. For example, for ex vivo administration a body fluid, such as blood, is removed from a subject and contacted outside the body with the antibody or portion thereof. For in vivo administration, the antibody or portion thereof can be introduced into the body, such as by local, topical, systemic and/or other route of introduction. In vitro administration encompasses methods, such as cell culture methods.

As used herein, unit dose form refers to physically discrete units suitable for human and animal subjects and packaged individually as is known in the art.

As used herein, a single dosage formulation refers to a formulation for direct administration.

As used herein, an "article of manufacture" is a product that is made and sold. As used throughout this application, the term is intended to encompass compiled germline antibodies or antibodies obtained therefrom contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, animal includes any animal, such as, but are not limited to primates including humans, gorillas and monkeys; rodents, such as mice and rats; fowl, such as chickens; ruminants, such as goats, cows, deer, sheep; mammals, such as pigs and other animals. Non-human animals exclude humans as the contemplated animal. The germline segments, and resulting antibodies, provided herein are from any source, animal, plant, prokaryotic and fungal. Most germline segments, and resulting antibodies, are of animal origin, including mammalian origin.

As used herein, a control refers to a sample that is substantially identical to the test sample, except that it is not treated with a test parameter, or, if it is a sample plasma sample, it can be from a normal volunteer not affected with the condition of interest. A control also can be an internal control.

As used herein, the singular forms "a," "an" and "the" include plural referents unless the context clearly dictates otherwise. Thus, for example, reference to compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Overview of Methods

Provided herein are methods of selecting antibodies with desired affinities and activities. The methods include affinity maturation and antibody conversion methods. The methods can be used to engineer antibodies to thereby identify or select antibodies that are antagonist antibodies, partial antagonist antibodies, agonist antibodies and/or activator/modulator antibodies. The ability to "tune" a particular pathway as opposed to completely inhibiting it would be an advantage for protein therapeutics. For example, pharmacologically, the ability to turn a pathway "on" or "off" by a high affinity interaction, might be less desirable than modulation of a pathway through "rheostat" based therapeutics. In other examples, an antibody with a high affinity is desired.

The resulting affinity-based or activity-based antibodies generated by practice of the methods can be used for any application or purpose as desired, including for example, in a variety of in vitro and in vivo applications by virtue of their specificity for one or more target proteins. Because of their diversity, specificity and effector functions, antibodies are attractive candidates for protein-based therapeutics. Accordingly, the methods provided herein for generating antibodies with desired affinities, specificities and/or activities permits their use as therapeutic antibodies. For example, the antibodies can be used in methods of treatment and other uses for treating a disease or disorder which is associated with expression or activation of a particular target protein, for which the antibody can modulate.

1. Antibody Polypeptides

In the methods provided herein, mutagenesis is typically performed on the variable region of the antibody. Accordingly, the parent antibody selected for affinity conversion or affinity maturation using the methods provided herein typically minimally include all or a portion of a variable heavy chain (VH) and/or a variable light (VL) chain so long as the antibody contains a sufficient antibody binding site. It is understood, however, that any antibody used or obtained by practice of the methods can be generated to include all or a portion of the constant heavy chain (e.g. one or more CH domains such as CH1, CH2, CH3 and CH4 and/or a constant light chain (CL)). Hence, the antibodies subjected to affinity conversion or affinity maturation herein include those that are full-length antibodies, and also include fragments or portions thereof including, for example, Fab, Fab', F(ab')$_2$, single-chain Fvs (scFv), Fv, dsFv, diabody, Fd and Fd' fragments, Fab fragments, scFv fragments, and scFab fragments. For example, antibodies affinity converted or affinity matured herein include Fabs.

A skilled artisan understands the structure, sequence and function of antibodies. A general description of the structure, sequence and function of antibodies is provided below.

a. Antibody Structure and Function

Antibodies are produced naturally by B cells in membrane-bound and secreted forms. In addition to naturally produced antibodies, antibodies also include synthetically, i.e. recombinantly, produced antibodies, such as antibody fragments. Antibodies specifically recognize and bind antigen epitopes through cognate interactions. Antibody binding to cognate antigens can initiate multiple effector functions, which cause neutralization and clearance of toxins, pathogens and other infectious agents. Diversity in antibody specificity arises naturally due to recombination events during B cell development. Through these events, various combinations of multiple antibody V, D and J gene segments, which encode variable regions of antibody molecules, are joined with constant region genes to generate a natural antibody repertoire with large numbers of diverse antibodies. A human antibody repertoire contains more than $10^{10}$ different antigen specificities and thus theoretically can specifically recognize any foreign antigen.

A full-length antibody contains four polypeptide chains, two identical heavy (H) chains (each usually containing about 440 amino acids) and two identical light (L) chains (each containing about 220 amino acids). The light chains exist in two distinct forms called kappa (κ) and lambda (λ). Each chain is organized into a series of domains organized as immunoglobulin (Ig) domains, including variable (V) and constant (C) region domains. Light chains have two domains, corresponding to the C region (CL) and the V region (VL). Heavy chains have four domains, the V region (VH) and three or four domains in the C region (CH1, CH2, CH3 and CH4), and, in some cases, hinge region. The four chains (two heavy and two light) are held together by a combination of covalent (disulfide) and non-covalent bonds.

Antibodies include those that are full-lengths and those that are fragments thereof, namely Fab, Fab', F(ab')$_2$, single-chain Fvs (scFv), Fv, dsFv, diabody, Fd and Fd' fragments. The fragments include those that are in single-chain or dimeric form. The Fv fragment, which contains only the VH and VL domain, is the smallest immunoglobulin fragment that retains the whole antigen-binding site (see, for example, *Methods in Molecular Biology*, Vol 207: *Recombinant Antibodies for Cancer Therapy Methods and Protocols* (2003);

Chapter 1; p 3-25, Kipriyanov). Stabilization of Fv are achieved by direct linkage of the VH and VL chains, such as for example, by linkage with peptides (to generate single-chain Fvs (scFv)), disulfide bridges or knob-into-hole mutations. Fab fragments, in contrast, are stable because of the presence of the CH1 and CL domains that hold together the variable chains. Fd antibodies, which contain only the VH domain, lack a complete antigen-binding site and can be insoluble.

In folded antibody polypeptides, binding specificity is conferred by antigen binding site domains, which contain portions of heavy and/or light chain variable region domains. Other domains on the antibody molecule serve effector functions by participating in events such as signal transduction and interaction with other cells, polypeptides and biomolecules. These effector functions cause neutralization and/or clearance of the infecting agent recognized by the antibody.

b. Antibody Sequence and Specificity

The variable region of the heavy and light chains are encoded by multiple germline gene segments separated by non-coding regions, or introns, and often are present on different chromosomes. During B cell differentiation germline DNA is rearranged whereby one $D_H$ and one $J_H$ gene segment of the heavy chain locus are recombined, which is followed by the joining of one $V_H$ gene segment forming a rearranged VDJ gene that encodes a VH chain. The rearrangement occurs only on a single heavy chain allele by the process of allelic exclusion. Allelic exclusion is regulated by in-frame or "productive" recombination of the VDJ segments, which occurs in only about one-third of VDJ recombinations of the variable heavy chain. When such productive recombination events first occur in a cell, this results in production of a µ heavy chain that gets expressed on the surface of a pre-B cell and transmits a signal to shut off further heavy chain recombination, thereby preventing expression of the allelic heavy chain locus. The surface-expressed µ heavy chain also acts to activate the kappa (κ) locus for rearrangement. The lambda (λ) locus is only activated for rearrangement if the κ recombination is unproductive on both loci. The light chain rearrangement events are similar to heavy chain, except that only the $V_L$ and $J_L$ segments are recombined. Before primary transcription of each, the corresponding constant chain gene is added. Subsequent transcription and RNA splicing leads to mRNA that is translated into an intact light chain or heavy chain.

The variable regions of antibodies confer antigen binding and specificity due to recombination events of individual germline V, D and J segments, whereby the resulting recombined nucleic acid sequences encoding the variable region domains differ among antibodies and confer antigen-specificity to a particular antibody. The variation, however, is limited to three complementarity determining regions (CDR1, CDR2, and CDR3) found within the N-terminal domain of the heavy (H) and (L) chain variable regions. The CDRs are interspersed with regions that are more conserved, termed "framework regions" (FR). The extent of the framework region and CDRs has been precisely defined (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). Each VH and VL is typically composed of three CDRs and four FRs arranged from the amino terminus to carboxy terminus in the following order: FR1, CDR1, FR2, CDR2, FR3, CDR3 and FR4. Sequence variability among VL and VH domains is generally limited to the CDRs, which are the regions that form the antigen binding site. For example, for the heavy chain, generally, $V_H$ genes encode the N-terminal three framework regions, the first two complete CDRs and the first part of the third CDR; the $D_H$ gene encodes the central portion of the third CDR, and the $J_H$ gene encodes the last part of the third CDR and the fourth framework region. For the light chain, the $V_L$ genes encode the first CDR and second CDR. The third CDR (CDRL3) is formed by the joining of the $V_L$ and $J_L$ gene segments. Hence, CDRs 1 and 2 are exclusively encoded by germline V gene segment sequences. The VH and VL chain CDR3s form the center of the Ag-binding site, while CDRs 1 and 2 form the outside boundaries; the FRs support the scaffold by orienting the H and L CDRs. On average, an antigen binding site typically requires that at least four of the CDRs make contact with the antigen's epitope, with CDR3 of both the heavy and light chain being the most variable and contributing the most specificity to antigen binding (see e.g., Janis Kuby, Immunology, Third Edition, New York, W.H. Freeman and Company, 1998, pp. 115-118). CDRH3, which includes all of the D gene segment, is the most diverse component of the Ab-binding site, and typically plays a critical role in defining the specificity of the Ab. In addition to sequence variation, there is variation in the length of the CDRs between the heavy and light chains.

The constant regions, on the other hand, are encoded by sequences that are more conserved among antibodies. These domains confer functional properties to antibodies, for example, the ability to interact with cells of the immune system and serum proteins in order to cause clearance of infectious agents. Different classes of antibodies, for example IgM, IgD, IgG, IgE and IgA, have different constant regions, allowing them to serve distinct effector functions.

These natural recombination events of V, D, and J, can provide nearly $2 \times 10^7$ different antibodies with both high affinity and specificity. Additional diversity is introduced by nucleotide insertions and deletions in the joining segments and also by somatic hypermutation of V regions. The result is that there are approximately $10^{10}$ antibodies present in an individual with differing antigen specificities.

2. Methods of Identifying Antibodies

Antibodies can be identified that have a binding specificity and/or activity against a target protein or antigen by any method known to one of skill in the art. For example, antibodies can be generated against a target antigen by conventional immunization methods resulting in the generation of hybridoma cells secreting the antibody (see e.g. Kohler et al. (1975) Nature, 256:495; Goding, Monoclonal Antibodies: Principles and Practice, pp. 59-103 (Macademic Press, 1986), Kozbor, J. Immunol., (1984) 133:3001; Brodeur et al., Monoclonal Antibody Production Techniques and Applications, pp. 51-63 (Marcel Dekker, Inc., New York, 1987). In another method, antibodies specific for a target antigen are identified by screening antibody libraries for the desired binding or activity. Antibody libraries can be provided as "one-pot" libraries containing a diverse population of antibody members, for example, as display libraries such as phage display libraries. In such libraries, the identity of each member of the library is typically unknown preceding sequencing of a positive clone with a desired binding activity.

In other examples, antibody libraries include addressable combinatorial antibody libraries as described in U.S. Provisional Application Nos. 61/198,764 and 61/211,204, and published International PCT Appl. No. WO2010054007, incorporated by reference herein. In the addressable libaries, the nucleic acid molecules encoding each VH chain and/or VL chain are individually synthesized, using standard DNA synthesis techniques, in an addressable format, whereby the identity of the nucleic acid sequence of each VH chain and/or VL chain in each locus is known. VH chains and VL chains are then paired, also in an addressable format, such that the identity of each member of the library is known based on its locus or "address". The addressable combinatorial antibody libraries can be screened for binding or activity against a target protein to identify antibodies or portions thereof that bind to a target protein and/or modulate an activity of a target protein. By virtue of the fact that these libraries are arrayed, the identity of each individual member in the collection is known during screening, thereby allowing facile comparison of "Hit" antibody.

3. Existing Methods of Optimizing Antibodies

Typically, the antibodies generated and/or identified by any of the above methods are of moderate affinity (e.g. $Kd^{-1}$ of about $10^6$ to $10^7$ $M^{-1}$). As discussed herein, existing methods of antibody discovery and engineering seek high-affinity antagonist antibodies. Thus, methods of affinity maturation to optimize and improve the binding affinity are employed to further optimize the antibody. An affinity matured antibody generally is one that contains one or more amino acid alterations that result in improvement of an activity, such as antigen binding affinity. Known method for affinity maturing and antibody include, for example, generating and screening antibody libraries using the previously identified antibody as a template by introducing mutations at random in vitro by using error-prone PCR (Zhou et al., *Nucleic Acids Research* (1991) 19(21):6052; and US2004/ 0110294); randomly mutating one or more CDRs or FRs (see e.g., WO 96/07754; Barbas et al. (1994) *Proc. Natl. Acad. Sci.*, 91:3809-3813; Cumbers et al. (2002) *Nat. Biotechnol.*, 20:1129-1134; Hawkins et al. (1992) *J. Mol. Biol.*, 226:889-896; Jackson et al., (1995) *J. Immunol.*, 154:3310-3319; Wu et al. (1998) *Proc. Natl. Acad. Sci.*, 95: 6037-6042; McCall et al. (1999) *Molecular Immunology*, 36:433-445); oligonucleotide directed mutagenesis (Rosok et al., *The Journal of Immunology*, (1998) 160:2353-2359); codon cassette mutagenesis (Kegler-Ebo et al., *Nucleic Acids Research*, (1994) 22(9):1593-1599); degenerate primer PCR, including two-step PCR and overlap PCR (U.S. Pat. Nos. 5,545,142, 6,248,516, and 7,189,841; Higuchi et al., *Nucleic Acids Research* (1988); 16(15):7351-7367; and Dubreuil et al., *The Journal of Biological Chemistry* (2005) 280(26):24880-24887); domain shuffling by recombining the VH or VL domains selected by phage display with repertoires of naturally occurring V domain variants obtained from unimmunized donors and screening for higher affinity in several rounds of chain reshuffling as described in Marks et al., *Biotechnology*, 10: 779-783 (1992).

Each of the available approaches for optimizing antibodies has limitations. First, the approaches fail to recognize that antibodies with low affinity are candidate therapeutics acting as agonists, partial agonist/antagonists or activator/ modulators. Where generating a high affinity antibody is desired, for example to generate an antagonist antibody, the existing affinity maturation approaches also are limited. For example, many available approaches carry the risk of introducing unwanted mutations (e.g. mutations at undesired positions) and/or biases against selection of particular mutants. Limitations in library size and completeness exist, since it is unfeasible to generate all possible combinations of mutants. Additionally, competition must be avoided to prevent abundant low-affinity variants from excluding rarer high-affinity variants. In addition, many of the affinity matured antibodies are produced either by VH and VL domain shuffling or by random mutagenesis of CDR and/or framework residues. These methods, however, require some type of displayed selection because of the vast number of clones to be evaluated. Finally, very high affinity antibodies are difficult to isolate by panning, since the elution conditions required to break a very strong antibody-antigen interaction are generally harsh enough (e.g., low pH, high salt) to denature the phage particle sufficiently to render it non-infective.

The methods provided herein overcome some or all of these limitations.

C. Method for Affinity Maturation of Antibodies

Provided herein is a rational method for affinity maturation of an antibody to improve its activity towards a target antigen based on the structure/activity relationship (SAR) of the antibody that is being affinity matured. The SAR can be used to identify a region or regions or particular amino acid residues in the antibody that are important for its activity (e.g. binding to a target antigen). For example, in the method, knowledge of the structure (e.g. sequence) of a "Hit" or parent antibody to be affinity matured is correlated to an activity (e.g. binding) for a target antigen. Such knowledge can be used to elucidate the region and/or amino acid residues that are involved in the activity toward the target antigen. The region(s) or amino acid residues are targeted for further mutagenesis. Thus, the SAR information provides guidance for further optimization by providing rational identification of region(s) of the antibody polypeptides to be mutagenized. The resulting mutant antibodies can be screened to identify those antibodies that are optimized compared to the starting or reference antibody.

In the methods provided herein, affinity maturation of a "Hit" or parent antibody is based on its structure-affinity/ activity-relationship. Thus, the method is a rational and targeted mutagenesis approach with much smaller libraries guided by SARs to identify regions and residues that modulate activity.

The SAR of an antibody can be determined by various approaches. For example, SAR can be determined by comparing the sequence of an antibody that has a desired activity for a target antigen to a related antibody that has reduced activity for the same target antigen to identify those amino acid residues that differ between the antibodies. The region of the antibody that exhibits amino acid differences is identified as a structure that is important in the activity of the antibody, and is targeted for further mutagenesis.

In particular, the SAR can be quickly elucidated using a spatially addressed combinatorial antibody library as described in U.S. Provisional Application No. 61/198,764 and U.S. Provisional Application No. 61/211,204; and in published International PCT Appl. No. WO2010054007. In the spatially addressed format, activities and binding affinities can be correlated to structure (e.g. sequence) coincident with a screening assay, since the sequences of addressed members are known a priori. In the spatially addressed format, the binding affinities of the hit versus nearby non-hit antibody can be compared in sequence space because their sequence identities are known a priori. Comparisons of sequence can be made between "Hits" and related antibodies that have less activity or no activity in the same assay. Such comparisons can reveal SARs and identify important regions or amino acid residues involved in the activity of the antibody. For example, such comparisons can reveal SARs of important CDRs and potentially important residues within the CDRs for binding the target. SAR also can be determined using other methods that identify regions of an antibody or amino acid residues therein that contribute to the activity of an antibody. For example, mutagenesis methods, for example, scanning mutagenesis, can be used to determine SAR.

The rational approach described herein facilitates identifying SARs that aid in the optimization of preliminary hits, mimicking the approach used in small molecule medicinal chemistry. This has advantages over existing methods of affinity maturation. Currently many of the in vitro affinity matured antibodies are produced either by VH and VL domain shuffling or by random mutagenesis of CDR and/or framework residues. Many of these methods, however, require some type of displayed selection because of the vast number of clones to be evaluated. In the method herein, a more rational and targeted mutagenesis approach is employed, using much smaller libraries guided by SARs and scanning mutagenesis to identify regions and residues that modulate affinity. True SARs can be identified because active hits can be compared with related, but less active or inactive antibodies present in the library. In addition, the methods herein can be practiced to avoid generating simultaneous mutations to circumvent exponential expansion of the library size. For example, for a given CDR or target region, one the best substitution is identified in each of the mutated positions, the mutations can be combined in a new antibody in order to generate further improvement in activity. In one example, binding affinity is increased. The increase in affinity, measured as a decrease in $K_d$, can be achieved through either an increase in association rate ($k_{on}$), a reduction in dissociation rate ($k_{off}$), or both.

In one aspect of the method, residues to mutagenize in the "Hit" antibody are identified by comparison of the amino acid sequence of the variable heavy or light chain of the "Hit" antibody with a respective variable heavy or light chain of a related antibody that exhibits reduced activity for the target antigen compared to the Hit antibody that is being affinity matured. In some examples, the related antibody is a non-Hit antibody that exhibits significantly less activity towards the target antigen than the Hit antibody, such as less than 80% of the activity, generally less than 50% of the activity, for example 5% to 50% of the activity, such as 50%, 40%, 30%, 20%, 10%, 5% or less the activity. For example, a no-Hit antibody can be one that exhibits no detectable activity or shows only negligible activity towards the target antigen. In practicing the method, a requisite level of relatedness between the "Hit" and a related antibody is required in order to permit rational analysis of the contributing regions to activity. This structure-affinity/activity relationship analysis between the "Hit" antibody and related antibodies reveals target regions of the antibody polypeptide that are important for activity.

In another aspect of the method provided herein, scanning mutagenesis can be used to reveal more explicit information about the structure/activity relationship of an antibody. In such a method, scanning mutagenesis is generally employed to identify residues to further mutate. Hence, scanning mutagenesis can be employed as the means to determine SAR. Alternatively or optionally, scanning mutagenesis can be used to in combination with the comparison method above. In such an example, once a target region is identified that is involved with an activity, scanning mutagenesis is used to further elucidate the role of individual amino acid residues in an activity in order to rationally select amino acid residues for mutagenesis. As discussed in detail below, in the scanning mutagenesis method herein only those scanned mutant residues that do not negatively impact the activity of the antibody (e.g. either preserve or increase an activity to the target antigen) are subjected to further mutagenesis by further mutating the scanned residue individually to other amino acids.

Once the SAR is determined, a target region containing residues important for activity are revealed in the variable heavy chain and/or variable light chain of an antibody. Once a target region is identified for either the variable heavy chain or light chain, mutagenesis of amino acid residues within the region is employed and mutants are screened for an activity towards the target antigen. In the methods herein, the mutagenized antibodies can be individually generated, such as by DNA synthesis or by recombinant DNA techniques, expressed, and assayed for their activity for a target antigen. By individually mutating each antibody, for example using cassette mutagenesis, simultaneous mutations can be avoided to avoid exponential expansion of the library. In addition, unwanted mutations can be avoided. In other examples, if desired, mutations can be effected by other mutagenesis approaches, for example by using various doping strategies, and the identity of the mutant identified upon screening and sequencing. Affinity maturation can be performed separately and independently on the variable heavy chain and variable light chain of a reference Hit antibody. The resulting affinity matured variable heavy and light chains can then be paired for further optimization of the antibody.

The affinity maturation method provided herein can be performed iteratively to further optimize binding affinity. For example, further optimization can be performed by mutagenesis and iterative screening of additional regions of the antibody polypeptide. At each step of the method, the affinity matured antibody can be tested for an activity (e.g. binding) to the target antigen. Antibodies are identified that have improved activity for the target antigen compared to the parent antibody or any intermediate antibody therefrom. Also, once the best substitutions in a region of an antibody are identified for improving an activity towards a target antigen, they can be combined to create a new antibody to further improve and optimize the antibodies activity. Such combination mutants can provide an additive improvement. Accordingly, the method of affinity maturation herein permits a rational optimization of antibody binding affinity.

1. Comparison of Structure and Activity

Provided herein is a method of affinity maturation based on the SAR of a Hit antibody by comparison of its structure and activity to a related antibody. In practicing the method, the amino acid sequence of the heavy chain and/or light chain of a "Hit" antibody is compared to the corresponding sequence of a related antibody that exhibits reduced or less activity for the target antigen compared to the "Hit" antibody. As discussed below, for purposes of practice of the method herein, the related antibody is sufficiently related in sequence to the "Hit" antibody in order to limit regions of the primary sequences that exhibit amino acid differences between the "Hit" and related antibody when compared (e.g. by sequence alignment). Thus, the method permits identification of a region of the "Hit" antibody that is involved in an activity to the target antigen. For example, alignment of the primary sequence (e.g. variable heavy chain and/or variable light chain) of the "Hit" and related antibody can identify one or more regions where amino acid differences exist between the "Hit" and the related antibody. The region(s) can be one or more of CDR1, CDR2 or CDR3 and/or can be amino acid residues within the framework regions of the antibody (e.g. FR1, FR2, FR3 or FR4). A region of the antibody that exhibits at least one amino acid difference compared to the corresponding region in the related antibody is a target region targeted for further mutagenesis.

In the method, mutagenesis to any other amino acid or to a subset of amino acids is performed on amino acid residues within the identified target region. For example, some or up to all amino acid residues of the selected region in the heavy chain and/or light chain of the "Hit" antibody are mutated, for example, 1, 2, 3, 4, 5, 6, 7, 8, 9, 10, 11, 12, 13, 14, 15, 16, 17, 18, 19, 20 or more amino acid residues. Each amino acid residue selected for mutagenesis can be mutated to all 19 other amino acid residues, or to a restricted subset thereof. The resulting mutant antibodies are screened for activity to the target antigen as compared to the starting "Hit" antibody. As discussed below, in some examples, prior to mutagenesis of individual amino acid residues, scanning-mutagenesis of all or select amino acid residues within the target region region can be used to identify particular residues for mutagenesis. The subset of identified residues are then subjected to mutagenesis to improve or optimize an activity towards the target antigen.

Typically, the method is performed on the variable heavy chain and/or variable light chain of the antibody. Typically, affinity maturation is separately performed for one or both of the heavy and/or light chain(s) of the "Hit" antibody independently of the other. The heavy and light chains can be affinity matured independently such as sequentially in any order. Alternatively, the heavy and light chain are subjected to affinity maturation in parallel. Mutant DNA molecules encoding the variable heavy chain and/or variable light chain are designed, generated by mutagenesis and cloned. In some examples, the modified variable heavy and light chains can be synthetically generated or generated by other recombinant means. Various combinations of heavy and light chains can be paired to generate libraries of variant antibodies. The resulting antibodies or fragments thereof are tested for an activity to the target antigen. Antibodies exhibiting an optimized or improved binding affinity as compared to the starting "Hit" antibody are selected.

Iterative screening can be performed to further optimize an activity to the target antigen. For example, mutations that increase an activity to the target antigen within a variable heavy or light chain can be combined, thereby creating an antibody that has an improved activity as compared to the starting "Hit" antibody and/or intermediate single mutant antibodies. Also, pairing of an affinity matured heavy chain with an affinity matured light chain can further optimize and improve the activity of resulting antibodies produced by practice of the method. Further, mutagenesis, e.g. scanning mutagenesis or full or partial saturation mutagenesis, of amino acid residues in one or more additional regions of the variable heavy or light chain can be performed to identify further mutations that further optimize an activity to the target antigen.

At any step in the method, the affinity matured antibodies can be further evaluated for activity. Any activity can be assessed, such as any exemplified in Section E herein. In one example, binding is assessed. Any method known to one of skill in the art can be used to measure the binding or binding affinity of an antibody. In one example, binding affinity is determined using surface Plasmon resonance (SPR). In another example, binding affinity is determined by dose response using ELISA. The resulting antibodies also can be tested for a functional activity as discussed elsewhere herein.

The resulting affinity matured antibodies are selected to have improved and/or optimized activity towards a target antigen compared to the parent "Hit" antibody. By practice of the method, the activity of an antibody for a target antigen can be improved at least 1.5-fold, generally at least 2-fold, for example at least 2-fold to 10000-fold, such as at least 2-fold, 5-fold, 10-fold, 100-fold, 200-fold, 300-fold, 400-fold, 500-fold, 600-fold, 700-fold, 800-fold, 900-fold, 1000-fold, 2000-fold, 3000-fold, 4000-fold, 5000-fold, 10000-fold or more. For example, the affinity matured antibodies generated by practice of the method can have a binding affinity for a target antigen that is improved, for example, that is or is about 1 $1\times10^{-9}$ M to $1\times10^{-11}$ M, generally $5\times10^{-9}$ M to $5\times10^{-10}$ M, such as at or about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $6\times10^{-10}$ M, $7\times10^{-10}$ M, $8\times10^{-10}$ M, $9\times10^{-10}$ M or less.

A summary of the steps of the method is set forth in FIG. 1. A detailed description of each step of the method is provided below. It is understood that the steps of the affinity maturation method provided herein are the same whether the method is performed on the variable heavy chain or variable light chain sequence of an antibody. Hence, for purposes herein, the description below applies to practice of the method on either one or both of the heavy and light chain sequences, unless explicitly stated otherwise. As discussed elsewhere herein, typically, affinity maturation is performed for one or both of the heavy and/or light chain(s) of the antibody independently of the other. If desired, an affinity matured heavy chain can be paired with an affinity matured light chain to further optimize or improve activity of the antibody.

a. Selection of a First Antibody for Affinity Maturation

The antibody chosen to be affinity matured is any antibody that is known in the art or identified as having an activity for a target antigen or antigens. For example, the antibody can be a "Hit" antibody, such as one identified in a screening assay. Generally, the antibody is an antibody that exhibits an activity for a target antigen such that it not ideal for use as a therapeutic because its affinity is not sufficiently high or such that improvement of its activity is achievable or desirable. For example, an antibody chosen for affinity maturation typically has a binding affinity for the target antigen that is at or about $10^{-5}$ M to $10^{-8}$ M, for example that is at or about $10^{-5}$ M, $10^{-6}$ M, $10^{-7}$ M, $10^{-8}$ M, or lower. Generally, an antibody selected for affinity maturation specifically binds to the target antigen. Assays to assess activity of an antibody for a target antigen are known in the art. Exemplary assays are provided in Section E.

Thus, the first antibody is an antibody that is known to have an activity to a target antigen. The target antigen can be a polypeptide, carbohydrate, lipid, nucleic acid or a small molecule (e.g. neurotransmitter). The antibody can exhibit activity for the antigen expressed on the surface of a virus, bacterial, tumor or other cell, or exhibits an activity (e.g. binding) for the purified antigen. Typically, the target antigen is a purified protein or peptide, including, for example, a recombinant protein.

Generally, the target antigen is a protein that is a target for a therapeutic intervention. Exemplary target antigens include, but are not limited to, targets involved in cell proliferation and differentiation, cell migration, apoptosis and angiogenesis. Such targets include, but are not limited to, growth factors, cytokines, lymphocytic antigens, other cellular activators and receptors thereof. Exemplary of such targets include, membrane bound receptors, such as cell surface receptors, including, but are not limited to, a VEGFR-1, VEGFR-2, VEGFR-3 (vascular endothelial growth factor receptors 1, 2, and 3), a epidermal growth factor receptor (EGFR), ErbB-2, ErbB-b3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epidermal growth factor homology domains receptor), CSF1R (colony stimulating factor 1 receptor), PDGFRB (platelet-derived growth factor receptor B), EPHA1, EPHA2, EPHB1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R and EPO-R. Other targets include membrane-bound proteins such as selected from among a cadherin, integrin, CD52 or CD44. Exemplary ligands that can be targets of the screening methods herein, include, but are not limited to, VEGF-A, VEGF-B, VEGF-C, VEGF-D, PIGF, EGF, HGF, TNF-α, LIGHT, BTLA, lymphotoxin (LT), IgE, G-CSF, GM-CSF and EPO. In some examples, the "Hit" antibody can bind to one or more antigens. For example, as exemplified in Example 1, "Hit" antibodies have been identified that binds to only one target antigen, e.g., DLL4, or that bind to two or more different target antigens, e.g., P-cadherin and erythropoietin (EPO).

In practicing the method provided herein, typically only the variable heavy chain and/or variable light chain of the antibody is affinity matured. Thus, the antibody that is chosen typically contains a variable heavy chain and a variable light chain, or portion thereof sufficient to form an antigen binding site. It is understood, however, that the antibody also can include all or a portion of the constant heavy chain (e.g. one or more CH domains, such as CH1, CH2, CH3 and CH4, and/or a constant light chain (CL)). Hence, the antibody can include those that are full-length antibodies, and also include fragments or portions thereof including, for example, Fab, Fab', F(ab')$_2$, single-chain Fvs (scFv), Fv, dsFv, diabody, Fd and Fd' fragments, Fab fragments, scFv fragments, and scFab fragments. For example, affinity maturation of antibodies exemplified in the examples herein are Fabs. It is understood that once the antibody is affinity matured as provided herein, the resulting antibody can be produced as a full-length antibody or a fragment thereof, such as a Fab, Fab', F(ab')$_2$, single-chain Fvs (scFv), Fv, dsFv, diabody, Fd and Fd' fragments, Fab fragments, scFv fragments, and scFab fragments. Further, the constant region of any isotype can be used in the generation of full or partial antibody fragments, including IgG, IgM, IgA, IgD and IgE constant regions. Such constant regions can be obtained from any human or animal species. It is understood that activities and binding affinities can differ depending on the structure of an antibody. For example, generally a bivalent antibody, for example a bivalent F(ab')$_2$ fragment or full-length IgG, has a better binding affinity then a monovalent Fab antibody. As a result, where a Fab has a specified binding affinity for a particular target, it is excepted that the binding affinity is even greater for a full-length IgG that is bivalent. Thus, comparison of binding affinities between a first antibody and an affinity matured antibody are typically made between antibodies that have the same structure, e.g. Fab compared to Fab.

An antibody for affinity maturation can include an existing antibody known to one of skill in the art. In other examples, an antibody is generated or identified empirically depending on a desired target. For example, an antibody can be generated using conventional immunization and hybridoma screening methods. In other examples, an antibody is identified by any of a variety of screening methods known to one of skill in the art.

i. Immunization and Hybridoma Screening

Antibodies specific for a target antigen can be made using the hybridoma method first described by Kohler et al. (1975) *Nature,* 256:495, or made by recombinant DNA methods (U.S. Pat. No. 4,816,567).

In the hybridoma method, a mouse or other appropriate host animal, such as a hamster, is immunized to elicit lymphocytes that produce or are capable of producing antibodies that will specifically bind to the protein used for immunization. Antibodies to a target antigen can be raised in animals by multiple subcutaneous (sc) or intraperitoneal (ip) injections of protein antigen and an adjuvant. Two weeks later, animals are boosted. 7 to 14 days later animals are bled and the serum is assayed for antibody titer specific for the target antigen. Animals are boosted until titers plateau.

Alternatively, lymphocytes can be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986)).

The hybridoma cells that are prepared are seeded and grown in a suitable culture medium that contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Myeloma cells include those that fuse efficiently, support stable high-level production of antibody by the selected antibody-producing cells, and are sensitive to a medium such as HAT medium. Among myeloma cell lines are murine myeloma lines, such as those derived from MOPC-21 and MPC-11 mouse tumors available from the Salk Institute Cell Distribution Center, San Diego, Calif., USA, and SP-2 or X63-Ag8-653 cells available from the American Type Culture Collection (ATCC), Rockville, Md., USA. Human myeloma and mouse-human heterocyeloma cells lines also have been described for the production of human monoclonal antibodies (Kozbor, (1984) *J. Immunol.,* 133:3001; and Brodeur et al., Monoclonal Antibody Production Techniques and Applications, pp. 51-63 (Marcel Dekker, Inc., New York, 1987)).

Culture medium in which hybridoma cells are growing is assayed for production of monoclonal antibodies directed against the target antigen. The binding specificity of monoclonal antibodies produced by hybridoma cells can be determined by any method known to one of skill in the art (e.g. as described in Section E.1), for example, by immunoprecipitation or by an in vitro binding assay, such as radioimmunoassay (RIA) or enzyme-linked immunoadsorbent assay (ELISA). The binding affinity also can be determined, for example, using Scatchard analysis.

After hybridoma cells are identified that produce antibodies of the desired specificity, affinity, and/or activity, the clones can be subcloned by limiting dilution procedures and grown by standard methods (Goding, Monoclonal Antibodies: Principles and Practice, pp. 59-103 (Academic Press, 1986)). Suitable culture media for this purpose include, for example, D-MEM or RPMI-1640 medium. In addition, the hybridoma cells can be grown in vivo as ascites tumors in an animal The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

DNA-encoding the hybridoma-derived monoclonal antibody can be readily isolated and sequenced using conventional procedures. For example, sequencing can be effected using oligonucleotide primers designed to specifically amplify the heavy and light chain coding regions of interest from the hybridoma. Once isolated, the DNA can be placed into expression vectors, which are then transfected into host cells such as *E. coli* cells, simian COS cells, Chinese hamster ovary (CHO) cells, or myeloma cells that do not otherwise produce immunoglobulin protein to obtain the synthesis of the desired monoclonal antibodies in the recombinant host cells.

ii. Screening Assays for Identification of a "Hit"

Antibodies that are affinity matured by the method herein can be identified by using combinatorial libraries to screen for synthetic antibody clones with the desired activity or activities. Antibodies with a desired activity can be selected as "Hits." Such "Hit" antibodies can be further affinity matured to optimize the activity.

1) Display Libraries

Typical of screening methods are high throughput screening of antibody libraries. For example, antibody libraries are screened using a display technique, such that there is a physical link between the individual molecules of the library (phenotype) and the genetic information encoding them (genotype). These methods include, but are not limited to, cell display, including bacterial display, yeast display and mammalian display, phage display (Smith, G. P. (1985) *Science* 228:1315-1317), mRNA display, ribosome display and DNA display. Using display techniques, the identity of each of the individual antibodies is unknown prior to screening, but the phenotype-genotype link allows for facile identification of selected antibodies. Prior to practice of the method herein, the sequence of a "Hit" antibody is determined Typically, in the libraries, nucleic acids encoding antibody gene fragments are obtained from immune cells harvested from humans or animals. If a library biased in favor of an antigen-specific antibody is desired, the subject is immunized with the target antigen to generate an antibody response, and spleen cells and/or circulating B cells or other peripheral blood lymphocytes (PBLs) are recovered for library construction. Additional enrichment for antigen-specific antibody reactive cell populations can be obtained using a suitable screening procedure to isolate B cells expressing antigen-specific membrane bound antibody, e.g. by cell separation with antigen affinity chromatography or adsorption of cells to fluorochrome-labeled antigen followed by fluorescence-activated cell sorting (FACs).

Alternatively, the use of spleen cells and/or B cells or other PBLs from an unimmunized donor provides a better representation of the possible antibody repertoire, and also permits the construction of an antibody library using any animal (human or non-human) species in which the target antigen is not antigenic. For libraries incorporating in vitro antibody gene construction, stem cells are harvested from the subject to provide nucleic acids encoding unrearranged antibody gene segments. The immune cells of interest can be obtained from a variety of animal species, such as human, mouse, rat, lagomorpha, lupine, canine, feline, porcine, bovine, equine, and avian species.

Nucleic acid encoding antibody variable gene segments (including VH and VL segments) can be recovered from the cells of interest and amplified. In the case of rearranged VH and VL gene libraries, the desired DNA can be obtained by isolating genomic DNA or mRNA from lymphocytes followed by polymerase chain reaction (PCR) with primers matching the 5' and 3' ends of rearranged VH and VL genes as described in Orlandi et al., (1989) *Proc. Natl. Acad. Sci. (USA)*, 86:3833-3837, thereby making diverse V gene repertoires for expression. The V genes can be amplified from cDNA and genomic DNA, with back primers at the 5' end of the exon encoding the mature V-domain and forward primers based within the J-segment as described in Orlandi et al., (1989) and in Ward et al., (1989) *Nature,* 341:544-546. For amplifying from cDNA, however, back primers can also be based in the leader exon as described in Jones et al., (1991) *Biotechnology,* 9:88-89, and forward primers within the constant region as described in Sastry et al., (1989) *Proc. Natl. Acad. Sci. (USA)*, 86:5728-5732. To maximize complementarity, degeneracy can be incorporated in the primers as described in Orlandi et al. (1989) or Sastry et al. (1989). The library diversity can be maximized by using PCR primers targeted to each V-gene family in order to amplify all available VH and VL arrangements present in the immune cell nucleic acid sample, e.g. as described in the method of Marks et al., (1991) *J. Mol. Biol.,* 222:581-597, or as described in the method of Orum et al., (1993) *Nucleic Acids Res.,* 21:4491-4498. For cloning of the amplified DNA into expression vectors, rare restriction sites can be introduced within the PCR primer as a tag at one end as described in Orlandi et al. (1989), or by further PCR amplification with a tagged primer as described in Clackson et al., (1991) *Nature,* 352:624-628.

In another example of generating an antibody library, repertoires of synthetically rearranged V genes can be derived in vitro from V gene segments. Most of the human VH-gene segments have been cloned and sequenced (see e.g. Tomlinson et al., (1992) *J. Mol. Biol.,* 227:776-798), and mapped (see e.g. Matsuda et al., (1993) *Nature Genet.,* 3:988-94). These segments can be used to generate diverse VH gene repertoires with PCR primers encoding H3 loops of diverse sequence and length as described in Hoogenboom and Winter (1992) *J. Mol. Biol.,* 227:381-388. VH repertoires also can be made with all of the sequence diversity focused in a long H3 loop of a single length as described in Barbas et al., (1992) *Proc. Nati. Acad. Sci. USA,* 89:4457-4461. Human Vκ and Vλ segments have been cloned and sequenced (see e.g. Williams and Winter (1993) *Eur. J. Immunol.,* 23:1456-1461) and can be used to make synthetic light chain repertoires. Synthetic V gene repertoires, based on a range of VH and VL folds, and L3 and H3 lengths, encode antibodies of considerable structural diversity. Following amplification of V-gene encoding DNAs, germline V-gene segments can be rearranged in vitro according to the methods of Hoogenboom and Winter (1992) *J. Mol. Biol.,* 227:381-388.

Repertoires of antibody fragments can be constructed by combining VH and VL gene repertoires together in several ways. Each repertoire can be created in different vectors, and the vectors recombined in vitro (see e.g. Hogrefe et al., (1993) *Gene,* 128:119-126), or in vivo by combinatorial infection, for example, using the lox P system (Waterhouse et al., (1993) *Nucl. Acids Res.,* 21:2265-2266). The in vivo recombination approach exploits the two-chain nature of Fab fragments to overcome the limit on library size imposed by *E. coli* transformation efficiency. Alternatively, the repertoires can be cloned sequentially into the same vector (see e.g. Barbas et al., (1991) *Proc. Nati. Acad. Sci. USA,* 88:7978-7982), or assembled together by PCR and then cloned (see e.g. Clackson et al., (1991) *Nature,* 352:624-628). PCR assembly can also be used to join VH and VL DNAs with DNA encoding a flexible peptide spacer to form single chain Fv (scFv) repertoires. In another technique, "in cell PCR assembly" can be used to combine VH and VL genes within lymphocytes by PCR and then clone repertoires of linked genes (see e.g. Embleton (1992) *Nucl. Acids Res.,* 20:3831-3837).

In typical display libraries, the repertoire of VH and VL chains are constructed as one-pot libraries, such that the sequence of each member of the library is not known. Accordingly, sequencing is required following identification of a "Hit" antibody in order to obtain any knowledge of the SAR relationship as required for practice of the method herein. Thus, as above for hybridoma-generated antibodies, DNA-encoding antibody clones identified from a display library can be readily isolated and sequenced using conventional procedures. For example, sequencing can be effected using oligonucleotide primers designed to specifically amplify the heavy and light chain coding regions of interest from a DNA template, e.g. phage DNA template.

Exemplary of such antibody libraries that can be used for screening are those described in any of the following: European Patent Application Nos. EP0368684 and EP89311731; International Published Patent Application Nos. WO92/001047, WO 02/38756, WO 97/08320, WO 2005/023993, WO 07/137616 and WO 2007/054816; U.S. Pat. Nos. 6,593,081 and 6,989,250; United States Published Patent Application Nos. US 2002/0102613, US 2003/0153038, US 2003/0022240, US 2005/0119455, US 2005/0079574 and US 2006/0234302; and Orlandi et al. (1989) *Proc Natl. Acad. Sci. U.S.A.,* 86:3833-3837; Ward et al. (1989) *Nature,* 341:544-546; Huse et al. (1989) *Science,* 246:1275-1281; Burton et al. (1991) *Proc. Natl. Acad. Sci.,* U.S.A., 88:10134-10137; Marks et al. (1991) *J Mol Biol,* 222:581-591; Hoogenboom et al. (1991) *J Mol Biol,* 227: 381-388; Nissim et al. (1994) *EMBO J,* 13:692-698; Barbas et al. (1992) *Proc. Natl. Acad. Sci.,* U.S.A., 89:4457-4461; Akamatsu et al. (1993)*J. Immunol.,* 151:4651-1659; Griffiths et al. (1994) *EMBO J,* 13:3245-3260; Fellouse (2004) *PNAS,* 101:12467-12472; Persson et al. (2006) *J. Mol. Biol.* 357:607-620; Knappik et al. (2000) *J. Mol. Biol.* 296:57-86; Rothe et al. (2008) *J. Mol. Biol.* 376:1182-1200; Mondon et al. (2008) *Frontiers in Bioscience,* 13:1117-1129; and Behar, I. (2007) *Expert Opin. Biol. Ther.,* 7:763-779.

2) Phage Display Libraries

For example, natural or synthetic antibodies are selected by screening phage libraries containing phage that display various fragments of antibody variable region (Fv) fused to phage coat protein. Variable domains can be displayed functionally on phage, either as single-chain Fv (scFv) fragments, in which VH and VL are covalently linked through a short, flexible peptide, or as Fab fragments, in which they are each fused to a constant domain and interact non-covalently, as described in Winter et al., (1994) *Ann. Rev. Immunol.,* 12:433-455. Such phage libraries are panned by affinity chromatography against the desired antigen. Clones expressing Fv fragments capable of binding to the desired antigen are bound to the antigen and thus separated from the non-binding clones in the library. The binding clones are then eluted from the antigen, and can be further enriched by additional cycles of antigen binding/elution. Any antibody can be obtained by designing a suitable antigen screening procedure to select for the phage clone of interest followed by construction of a full length antibody clone using the Fv sequences from the phage clone of interest and suitable constant region (Fc) sequences described in Kabat et al., Sequences of Proteins of Immunological Interest, Fifth Edition, NIH Publication 91-3242, Bethesda Md. (1991), vols. 1-3.

Repertoires of VH and VL genes can be separately cloned by polymerase chain reaction (PCR) and recombined randomly in phage libraries, which can then be searched for antigen-binding clones as described in Winter et al., *Ann. Rev. Immunol.,* 12: 433-455 (1994). Libraries from immunized sources provide high-affinity antibodies to the immunogen without the requirement of constructing hybridomas. Alternatively, the naive repertoire can be cloned to provide a single source of human antibodies to a wide range of non-self and also self antigens without any immunization as described by Griffiths et al., *EMBO J.* 12: 725-734 (1993). Finally, naive libraries can also be made synthetically by cloning the unrearranged V-gene segments from stem cells, and using PCR primers containing random sequence to encode the highly variable CDR3 regions and to accomplish rearrangement in vitro as described by Hoogenboom and Winter, *J. Mol. Biol.,* 227: 381-388 (1992).

VH and VL repertoires are cloned separately, one into a phagemid and the other into a phage vector. The two libraries are then combined by phage infection of phagemid-containing bacteria so that each cell contains a different combination and the library size is limited only by the number of cells present (about $10^{12}$ clones). Both vectors contain in vivo recombination signals so that the VH and VL genes are recombined onto a single replicon and are co-packaged into phage virions. The libraries can provide a large number of diverse antibodies of good affinity ($Kd^{-1}$ of about $10^{-8}$ M).

Filamentous phage is used to display antibody fragments by fusion to a coat protein, for example, the minor coat protein pIII. The antibody fragments can be displayed as single chain Fv fragments, in which VH and VL domains are connected on the same polypeptide chain by a flexible polypeptide spacer, e.g. as described by Marks et al., *J. Mol. Biol.,* 222: 581-597 (1991), or as Fab fragments, in which one chain is fused to pIII and the other is secreted into the bacterial host cell periplasm where assembly of a Fab-coat protein structure which becomes displayed on the phage surface by displacing some of the wild type coat proteins, e.g. as described in Hoogenboom et al., *Nucl. Acids Res.,* 19: 4133-4137 (1991).

3) Addressable Libraries

Another method of identifying antibodies, or fragments thereof, that have a desired specificity and/or activity for a target protein includes addressable combinatorial antibody libraries as described in U.S. Provisional Application Nos. 61/198,764 and 61/211,204, and in International published PCT Appl. No. WO2010054007, incorporated by reference herein. These include, for example, spatially addressed combinatorial antibody libraries. An advantage of addressable combinatorial libraries compared to display libraries is that each loci represents a different library member whose identity is known by virtue of its address. In such libraries, each individual member of the library is individually generated, and thus the sequence of each member is known. Display of the members of the library can be achieved on any desired format, which permits screening the members not only for binding but also for function. The "Hits" can be quickly identified, including by sequence, coincident with the screening results. Sequencing is not required to obtain structural information about an identified antibody since the sequence of an identified "Hit" is known a priori. Accordingly, affinity maturation of a "Hit" antibody can be performed immediately after screening and identification of a "Hit" antibody.

Addressable combinatorial antibody libraries contain antibodies with variable heavy chain and variable light chains composed of recombined human germline segments. Antibody combinatorial diversity in the library exists from recombination of individual V, D and J segments that make up the variable heavy chains and of individual V ($V_\kappa$ or $V_\lambda$) and J ($J_\kappa$ or $J_\lambda$) segments that make up the variable light chains. Additional combinatorial diversity derives from the pairing of different variable heavy chains and variable light chains.

The nucleic acid molecules encoding each VH chain and/or VL chain are individually synthesized, using standard DNA synthesis techniques, in an addressable format, whereby the identity of the nucleic acid sequence of each VH chain and/or VL chain in each locus is known. VH chains and VL chains are then paired, also in an addressable format, such that the identity of each member of the library is known based on its locus or "address". The addressable combinatorial antibody libraries can be screened for binding or activity against a target protein to identify antibodies or portions thereof that bind to a target protein and/or modulate an activity of a target protein. By virtue of the fact that these libaries are arrayed, the identity of each individual member in the collection is known during screening, thereby allowing facile comparison of "Hit" and related "non-Hit" antibodies.

U.S. Provisional Appl. Nos. 61/198,764 and 61/211,204, and published International PCT Appl. No. WO2010054007, incorporated by reference herein, provide a method of generating a combinatorial antibody library where the identity of every antibody is known at the time of screening by virtue of the combinatorial generation of antibody members. In the combinatorial addressable libraries, variable heavy (VH) and variable light (VL) chain members of the libraries are generated, recombinantly or synthetically by DNA synthesis, from known germline antibody sequences or modified sequences thereof. Antibody combinatorial diversity in the library exists from recombination of individual V, D and J segments that make up the variable heavy chains and of individual V ($V_\kappa$ or $V_\lambda$) and J ($J_\lambda$ or $J_\lambda$) segments that make up the variable light chains. Additional combinatorial diversity derives from the pairing of different variable heavy chains and variable light chains.

Each VL chain of the antibodies in the library is encoded by a nucleic acid molecule that contains a $V_\kappa$ and a $J_\kappa$ human germline segment or degenerate codons thereof, or a $V_\lambda$ and a $J_\lambda$ human germline segment or degenerate codons thereof, whereby the segments are linked in-frame. The germline segments are joined such that the $V_L$ segment is 5' of the $J_L$ segment. Each VH chain of the antibodies in the library is encoded by a nucleic acid molecule that contains a $V_H$, $D_H$ and a $J_H$ germline segment, whereby the segments are linked in-frame. The germline segments are joined such that the $V_H$ segment is 5' of the $D_H$ segment, which is 5' of the $J_H$ segment.

The recombination is effected so that each gene segment is in-frame, such that resulting recombined nucleic acid molecules encodes a functional VH or VL polypeptide. For example, recombed segments are joined such that the recombined full length nucleic acid is in frame with the 5' start codon (ATG), thereby allowing expression of a full length polypeptide. Any combination of a V(D)J can be made, and junctions modified accordingly in order to generate a compiled V(D)J sequence that is in-frame, while preserving reading frames of each segment. The choice of junction modification is a function of the combination of V(D)J that will be joined, and the proper reading frame of each gene segment. In some examples, the nucleic acid molecule encoding a VH chain and/or a VL chain are further modified to remove stop codons and/or restriction enzyme sites so that the resulting encoded polypeptide is in-frame and functional.

A nucleic acid that encodes a variable heavy chain or a variable light chain is generated as follows. In the first step, individual germline segments ($V_H$, $D_H$ and $J_H$ for a heavy chain or $V_\kappa$ and a $J_\kappa$, or $V_\lambda$, and $J_\lambda$, for a light chain) are selected for recombination. The germline segments can be human germline segments, or degenerate sequences thereof, or alternatively the germline segments can be modified. For example, the $D_H$ segment of a variable heavy chain can be translated in any open reading frame, or alternatively, the $D_H$ segment can be the reverse complement of a $D_H$ germline segment. Once selected, the germline segments are joined such that the recombined full length nucleic acid is in frame with the 5' start codon (ATG), thereby allowing expression of a full length polypeptide. Any combination of a V(D)J can be made, and junctions modified accordingly in order to generate a compiled V(D)J sequence that is in-frame, while preserving reading frames of each segment. The V segment is always reading frame 1. The reading frame of the J segment is selected so the correct amino acids are encoded. The D segment can be in any reading frame, but typically, the reading frame is chosen such that the resulting amino acids are predominately hydrophobic. As necessary, nucleic acid modifications are made at the junctions between the gene segments such that each segment is in the desired reading frame. For example, at the V-D junction, one or more nucleotides can be deleted from the 5' end of the D, one or more nucleotides can be deleted from the 3' end of the V or one or more nucleotides can be inserted between the V and D (e.g. a nucleotide can be added to the 3' end of the V). Once the junctions are formed, the sequence is modified to remove any stop codons by substitution of nucleotides, such that stop codon TAA is replaced by codon TAT; stop codon TAG is replaced by codon TAT, and stop codon TGA is replaced by codon TCA. Finally, the nucleic acid can be further modified to, for example, remove unwanted restriction sites, splicing donor or acceptor sites, or other nucleotide sequences potentially detrimental to efficient translation. Modifications of the nucleic acid sequences include replacements or substitutions, insertions, or deletions of nucleotides, or any combination thereof.

The nucleic acid molecules encoding each VH chain and/or VL chain are individually synthesized, using standard DNA synthesis techniques, in an addressable format, whereby the identity of the nucleic acid sequence of each VH chain and/or VL chain in each locus is known.

VH chains and VL chains are then paired, also in an addressable format, such that the identity of each member of the library is known based on its locus or "address". For example, resulting members of the library are produced by co-expression of nucleic acid molecules encoding the recombined variable region genes together, such that when expressed, a combinatorial antibody member is generated minimally containing a VH and VL chain, or portions thereof. In some examples of the methods, the nucleic acid molecule encoding the VH and VL chain can be expressed as a single nucleic acid molecule, whereby the genes encoding the heavy and light chain are joined by a linker. In another example of the methods, the nucleic acid molecules encoding the VH and VL chain can be separately provided for expression together. Thus, upon expression from the recombined nucleic acid molecules, each different member of the library represents a germline encoded antibody, whereby diversity is achieved by combinatorial diversity of V(D)J segments and pairing diversity of heavy and light chains.

The antibodies within the combinatorial addressable germline antibody libraries contain all or a portion of the variable heavy chain (VH) and variable light chain (VL), as long as the resulting antibody is sufficient to form an antigen binding site. Typically, the combinatorial addressable germline antibodies are Fabs. Exemplary nucleic acids encoding variable heavy chains and light chains are set forth in Table 3 below. A library of antibodies can be generated upon co-expression of a nucleic acid molecule encoding the VH chain and a nucleic acid encoding the VL chain to generate a combinatorial library containing a plurality of different members. An exemplary paired nucleic acid library is set forth in Table 4 below, where each row sets forth a different loci of the library. The combinatorial addressable antibody library can be screened to identify a "Hit" antibody against any target antigen. Related non-Hit antibodies that do not bind the target antigen also can be readily identified, since the identity by sequence structure of each "Hit" or "non-Hit" are immediately known coincident with the binding results.

TABLE 3

Exemplary Variable Heavy Chains and Light Chains

| Number | Name | SEQ ID NO. |
|---|---|---|
| | Heavy Chain | |
| 1 | gnl|Fabrus|VH1-18__IGHD1-26*01__IGHJ2*01 | 1828 |
| 2 | gnl|Fabrus|VH1-18__IGHD2-21*01__IGHJ2*01 | 1829 |
| 3 | gnl|Fabrus|VH1-18__IGHD3-16*01__IGHJ6*01 | 1830 |
| 4 | gnl|Fabrus|VH1-18__IGHD3-22*01__IGHJ4*01 | 1831 |
| 5 | gnl|Fabrus|VH1-18__IGHD4-23*01__IGHJ1*01 | 1832 |
| 6 | gnl|Fabrus|VH1-18__IGHD5-12*01__IGHJ4*01 | 1833 |
| 7 | gnl|Fabrus|VH1-18__IGHD6-6*01__IGHJ1*01 | 1834 |
| 8 | gnl|Fabrus|VH1-2__IGHD1-1*01__IGHJ3*01 | 1835 |
| 9 | gnl|Fabrus|VH1-24__IGHD1-7*01__IGHJ4*01 | 1836 |
| 10 | gnl|Fabrus|VH1-24__IGHD2-15*01__IGHJ2*01 | 1837 |
| 11 | gnl|Fabrus|VH1-24__IGHD3-10*01__IGHJ4*01 | 1838 |
| 12 | gnl|Fabrus|VH1-24__IGHD3-16*01__IGHJ4*01 | 1839 |
| 13 | gnl|Fabrus|VH1-24__IGHD4-23*01__IGHJ2*01 | 1840 |
| 14 | gnl|Fabrus|VH1-24__IGHD5-12*01__IGHJ4*01 | 1841 |
| 15 | gnl|Fabrus|VH1-24__IGHD5-18*01__IGHJ6*01 | 1842 |
| 16 | gnl|Fabrus|VH1-24__IGHD6-19*01__IGHJ4*01 | 1843 |
| 17 | gnl|Fabrus|VH1-3__IGHD2-15*01__IGHJ2*01 | 1844 |
| 18 | gnl|Fabrus|VH1-3__IGHD2-2*01__IGHJ5*01 | 1845 |
| 19 | gnl|Fabrus|VH1-3__IGHD3-9*01__IGHJ6*01 | 1846 |
| 20 | gnl|Fabrus|VH1-3__IGHD4-23*01__IGHJ4*01 | 101 |
| 21 | gnl|Fabrus|VH1-3__IGHD5-18*01__IGHJ4*01 | 1847 |
| 22 | gnl|Fabrus|VH1-3__IGHD6-6*01__IGHJ1*01 | 1848 |
| 23 | gnl|Fabrus|VH1-3__IGHD7-27*01__IGHJ4*01 | 1849 |
| 24 | gnl|Fabrus|VH1-45__IGHD1-26*01__IGHJ4*01 | 1850 |
| 25 | gnl|Fabrus|VH1-45__IGHD2-15*01__IGHJ6*01 | 1851 |
| 26 | gnl|Fabrus|VH1-45__IGHD2-8*01__IGHJ3*01 | 1852 |
| 27 | gnl|Fabrus|VH1-45__IGHD3-10*01__IGHJ4*01 | 1853 |
| 28 | gnl|Fabrus|VH1-45__IGHD3-16*01__IGHJ2*01 | 1854 |
| 29 | gnl|Fabrus|VH1-45__IGHD4-23*01__IGHJ4*01 | 1855 |
| 30 | gnl|Fabrus|VH1-45__IGHD5-24*01__IGHJ4*01 | 1856 |
| 31 | gnl|Fabrus|VH1-45__IGHD6-19*01__IGHJ4*01 | 1857 |
| 32 | gnl|Fabrus|VH1-45__IGHD7-27*01__IGHJ6*01 | 1858 |
| 33 | gnl|Fabrus|VH1-46__IGHD1-26*01__IGHJ4*01 | 1859 |
| 34 | gnl|Fabrus|VH1-46__IGHD2-15*01__IGHJ2*01 | 99 |
| 35 | gnl|Fabrus|VH1-46__IGHD3-10*01__IGHJ4*01 | 92 |
| 36 | gnl|Fabrus|VH1-46__IGHD4-17*01__IGHJ4*01 | 1860 |
| 37 | gnl|Fabrus|VH1-46__IGHD5-18*01__IGHJ4*01 | 1861 |
| 38 | gnl|Fabrus|VH1-46__IGHD6-13*01__IGHJ4*01 | 93 |
| 39 | gnl|Fabrus|VH1-46__IGHD6-6*01__IGHJ1*01 | 88 |
| 40 | gnl|Fabrus|VH1-46__IGHD7-27*01__IGHJ2*01 | 97 |
| 41 | gnl|Fabrus|VH1-58__IGHD1-26*01__IGHJ4*01 | 1862 |
| 42 | gnl|Fabrus|VH1-58__IGHD2-15*01__IGHJ2*01 | 1863 |
| 43 | gnl|Fabrus|VH1-58__IGHD3-10*01__IGHJ6*01 | 1864 |
| 44 | gnl|Fabrus|VH1-58__IGHD4-17*01__IGHJ4*01 | 1865 |
| 45 | gnl|Fabrus|VH1-58__IGHD5-18*01__IGHJ4*01 | 1866 |
| 46 | gnl|Fabrus|VH1-58__IGHD6-6*01__IGHJ1*01 | 1867 |
| 47 | gnl|Fabrus|VH1-58__IGHD7-27*01__IGHJ5*01 | 1868 |
| 48 | gnl|Fabrus|VH1-69__IGHD1-1*01__IGHJ6*01 | 98 |
| 49 | gnl|Fabrus|VH1-69__IGHD1-14*01__IGHJ4*01 | 1869 |
| 50 | gnl|Fabrus|VH1-69__IGHD2-2*01__IGHJ4*01 | 1870 |
| 51 | gnl|Fabrus|VH1-69__IGHD2-8*01__IGHJ6*01 | 1871 |
| 52 | gnl|Fabrus|VH1-69__IGHD3-16*01__IGHJ4*01 | 1872 |
| 53 | gnl|Fabrus|VH1-69__IGHD3-3*01__IGHJ4*01 | 1873 |
| 54 | gnl|Fabrus|VH1-69__IGHD3-9*01__IGHJ6*01 | 1874 |
| 55 | gnl|Fabrus|VH1-69__IGHD4-17*01__IGHJ4*01 | 1875 |
| 56 | gnl|Fabrus|VH1-69__IGHD5-12*01__IGHJ4*01 | 1876 |
| 57 | gnl|Fabrus|VH1-69__IGHD5-24*01__IGHJ6*01 | 1877 |
| 58 | gnl|Fabrus|VH1-69__IGHD6-19*01__IGHJ4*01 | 1878 |
| 59 | gnl|Fabrus|VH1-69__IGHD6-6*01__IGHJ1*01 | 1879 |
| 60 | gnl|Fabrus|VH1-69__IGHD7-27*01__IGHJ4*01 | 1880 |
| 61 | gnl|Fabrus|VH1-8__IGHD1-26*01__IGHJ4*01 | 1881 |
| 62 | gnl|Fabrus|VH1-8__IGHD2-15*01__IGHJ6*01 | 1882 |
| 63 | gnl|Fabrus|VH1-8__IGHD2-2*01__IGHJ6*01 | 102 |
| 64 | gnl|Fabrus|VH1-8__IGHD3-10*01__IGHJ4*01 | 1883 |
| 65 | gnl|Fabrus|VH1-8__IGHD4-17*01__IGHJ4*01 | 1884 |
| 66 | gnl|Fabrus|VH1-8__IGHD5-5*01__IGHJ4*01 | 1885 |
| 67 | gnl|Fabrus|VH1-8__IGHD7-27*01__IGHJ4*01 | 1886 |
| 68 | gnl|Fabrus|VH2-26__IGHD1-20*01__IGHJ4*01 | 1887 |
| 69 | gnl|Fabrus|VH2-26__IGHD2-15*01__IGHJ2*01 | 1888 |
| 70 | gnl|Fabrus|VH2-26__IGHD2-2*01__IGHJ4*01 | 1889 |
| 71 | gnl|Fabrus|VH2-26__IGHD3-10*01__IGHJ4*01 | 1890 |
| 72 | gnl|Fabrus|VH2-26__IGHD3-9*01__IGHJ6*01 | 1891 |
| 73 | gnl|Fabrus|VH2-26__IGHD4-11*01__IGHJ4*01 | 1892 |
| 74 | gnl|Fabrus|VH2-26__IGHD5-12*01__IGHJ4*01 | 1893 |
| 75 | gnl|Fabrus|VH2-26__IGHD5-18*01__IGHJ4*01 | 1894 |
| 76 | gnl|Fabrus|VH2-26__IGHD6-13*01__IGHJ4*01 | 1895 |
| 77 | gnl|Fabrus|VH2-26__IGHD7-27*01__IGHJ4*01 | 1896 |
| 78 | gnl|Fabrus|VH2-26__IGHD7-27*01__IGHJ4*01 | 1897 |
| 79 | gnl|Fabrus|VH2-5__IGHD1-1*01__IGHJ5*01 | 1898 |
| 80 | gnl|Fabrus|VH2-5__IGHD2-15*01__IGHJ6*01 | 1899 |
| 81 | gnl|Fabrus|VH2-5__IGHD3-16*01__IGHJ4*01 | 1900 |
| 82 | gnl|Fabrus|VH2-5__IGHD3-9*01__IGHJ6*01 | 1901 |
| 83 | gnl|Fabrus|VH2-5__IGHD5-12*01__IGHJ4*01 | 1902 |
| 84 | gnl|Fabrus|VH2-5__IGHD6-13*01__IGHJ4*01 | 1903 |
| 85 | gnl|Fabrus|VH2-5__IGHD7-27*01__IGHJ2*01 | 96 |
| 86 | gnl|Fabrus|VH2-70__IGHD1-1*01__IGHJ2*01 | 1904 |
| 87 | gnl|Fabrus|VH2-70__IGHD2-15*01__IGHJ2*01 | 1905 |
| 88 | gnl|Fabrus|VH2-70__IGHD3-22*01__IGHJ4*01 | 1906 |
| 89 | gnl|Fabrus|VH2-70__IGHD3-9*01__IGHJ6*01 | 1907 |
| 90 | gnl|Fabrus|VH2-70__IGHD5-12*01__IGHJ4*01 | 1908 |
| 91 | gnl|Fabrus|VH2-70__IGHD7-27*01__IGHJ2*01 | 1909 |
| 92 | gnl|Fabrus|VH3-11__IGHD1-26*01__IGHJ4*01 | 1910 |
| 93 | gnl|Fabrus|VH3-11__IGHD2-2*01__IGHJ6*01 | 1911 |
| 94 | gnl|Fabrus|VH3-11__IGHD3-16*01__IGHJ4*01 | 1912 |
| 95 | gnl|Fabrus|VH3-11__IGHD3-9*01__IGHJ6*01 | 1913 |
| 96 | gnl|Fabrus|VH3-11__IGHD4-23*01__IGHJ5*01 | 1914 |
| 97 | gnl|Fabrus|VH3-11__IGHD5-18*01__IGHJ4*01 | 1915 |
| 98 | gnl|Fabrus|VH3-11__IGHD6-19*01__IGHJ6*01 | 1916 |
| 99 | gnl|Fabrus|VH3-11__IGHD6-6*01__IGHJ1*01 | 1917 |
| 100 | gnl|Fabrus|VH3-11__IGHD7-27*01__IGHJ4*01 | 1918 |
| 101 | gnl|Fabrus|VH3-13__IGHD1-26*01__IGHJ4*01 | 1919 |
| 102 | gnl|Fabrus|VH3-13__IGHD2-8*01__IGHJ5*01 | 1920 |
| 103 | gnl|Fabrus|VH3-13__IGHD3-3*01__IGHJ1*01 | 1921 |
| 104 | gnl|Fabrus|VH3-13__IGHD3-9*01__IGHJ6*01 | 1922 |
| 105 | gnl|Fabrus|VH3-13__IGHD4-23*01__IGHJ5*01 | 1923 |
| 106 | gnl|Fabrus|VH3-13__IGHD5-5*01__IGHJ4*01 | 1924 |
| 107 | gnl|Fabrus|VH3-13__IGHD6-6*01__IGHJ1*01 | 1925 |
| 108 | gnl|Fabrus|VH3-13__IGHD7-27*01__IGHJ5*01 | 1926 |
| 109 | gnl|Fabrus|VH3-15__IGHD1-26*01__IGHJ4*01 | 1927 |
| 110 | gnl|Fabrus|VH3-15__IGHD2-15*01__IGHJ2*01 | 1928 |
| 111 | gnl|Fabrus|VH3-15__IGHD2-15*01__IGHJ6*01 | 1929 |
| 112 | gnl|Fabrus|VH3-15__IGHD3-10*01__IGHJ4*01 | 1930 |
| 113 | gnl|Fabrus|VH3-15__IGHD3-9*01__IGHJ2*01 | 1931 |
| 114 | gnl|Fabrus|VH3-15__IGHD5-12*01__IGHJ4*01 | 1932 |
| 115 | gnl|Fabrus|VH3-15__IGHD6-6*01__IGHJ1*01 | 1933 |

TABLE 3-continued

Exemplary Variable Heavy Chains and Light Chains

| Number | Name | SEQ ID NO. |
|---|---|---|
| 116 | gnl\|Fabrus\|VH3-16__IGHD1-1*01__IGHJ1*01 | 1934 |
| 117 | gnl\|Fabrus\|VH3-16__IGHD1-7*01__IGHJ6*01 | 1935 |
| 118 | gnl\|Fabrus\|VH3-16__IGHD2-15*01__IGHJ2*01 | 1936 |
| 119 | gnl\|Fabrus\|VH3-16__IGHD2-2*01__IGHJ2*01 | 1937 |
| 120 | gnl\|Fabrus\|VH3-16__IGHD3-10*01__IGHJ4*01 | 1938 |
| 121 | gnl\|Fabrus\|VH3-16__IGHD4-4*01__IGHJ2*01 | 1939 |
| 122 | gnl\|Fabrus\|VH3-16__IGHD5-24*01__IGHJ4*01 | 1940 |
| 123 | gnl\|Fabrus\|VH3-16__IGHD6-13*01__IGHJ4*01 | 1941 |
| 124 | gnl\|Fabrus\|VH3-16__IGHD7-27*01__IGHJ2*01 | 1942 |
| 125 | gnl\|Fabrus\|VH3-20__IGHD1-14*01__IGHJ4*01 | 1943 |
| 126 | gnl\|Fabrus\|VH3-20__IGHD2-15*01__IGHJ2*01 | 1944 |
| 127 | gnl\|Fabrus\|VH3-20__IGHD2-8*01__IGHJ4*01 | 1945 |
| 128 | gnl\|Fabrus\|VH3-20__IGHD3-10*01__IGHJ4*01 | 1946 |
| 129 | gnl\|Fabrus\|VH3-20__IGHD3-9*01__IGHJ6*01 | 1947 |
| 130 | gnl\|Fabrus\|VH3-20__IGHD4-23*01__IGHJ4*01 | 1948 |
| 131 | gnl\|Fabrus\|VH3-20__IGHD5-12*01__IGHJ4*01 | 1949 |
| 132 | gnl\|Fabrus\|VH3-20__IGHD6-13*01__IGHJ4*01 | 1950 |
| 133 | gnl\|Fabrus\|VH3-20__IGHD7-27*01__IGHJ2*01 | 1951 |
| 134 | gnl\|Fabrus\|VH3-21__IGHD1-26*01__IGHJ4*01 | 1952 |
| 135 | gnl\|Fabrus\|VH3-21__IGHD2-2*01__IGHJ5*01 | 1953 |
| 136 | gnl\|Fabrus\|VH3-21__IGHD3-22*01__IGHJ4*01 | 1954 |
| 137 | gnl\|Fabrus\|VH3-21__IGHD4-23*01__IGHJ5*01 | 1955 |
| 138 | gnl\|Fabrus\|VH3-21__IGHD5-24*01__IGHJ5*01 | 1956 |
| 139 | gnl\|Fabrus\|VH3-21__IGHD6-19*01__IGHJ1*01 | 1957 |
| 140 | gnl\|Fabrus\|VH3-21__IGHD7-27*01__IGHJ4*01 | 1958 |
| 141 | gnl\|Fabrus\|VH3-23__IGHD1-1*01__IGHJ1*01 | 1959 |
| 142 | gnl\|Fabrus\|VH3-23__IGHD1-1*01__IGHJ4*01 | 1960 |
| 143 | gnl\|Fabrus\|VH3-23__IGHD1-20*01__IGHJ3*01 | 1961 |
| 144 | gnl\|Fabrus\|VH3-23__IGHD1-26*01__IGHJ4*01 | 1962 |
| 145 | gnl\|Fabrus\|VH3-23__IGHD2-15*01__IGHJ4*01 | 1963 |
| 146 | gnl\|Fabrus\|VH3-23__IGHD2-21*01__IGHJ1*01 | 1964 |
| 147 | gnl\|Fabrus\|VH3-23__IGHD3-10*01__IGHJ4*01 | 1965 |
| 148 | gnl\|Fabrus\|VH3-23__IGHD3-16*01__IGHJ4*01 | 1966 |
| 149 | gnl\|Fabrus\|VH3-23__IGHD3-22*01__IGHJ4*01 | 1967 |
| 150 | gnl\|Fabrus\|VH3-23__IGHD3-3*01__IGHJ5*01 | 1968 |
| 151 | gnl\|Fabrus\|VH3-23__IGHD4-11*01__IGHJ4*01 | 1969 |
| 152 | gnl\|Fabrus\|VH3-23__IGHD4-23*01__IGHJ2*01 | 1970 |
| 153 | gnl\|Fabrus\|VH3-23__IGHD5-12*01__IGHJ4*01 | 1971 |
| 154 | gnl\|Fabrus\|VH3-23__IGHD5-24*01__IGHJ1*01 | 1972 |
| 155 | gnl\|Fabrus\|VH3-23__IGHD5-5*01__IGHJ4*01 | 1973 |
| 156 | gnl\|Fabrus\|VH3-23__IGHD6-13*01__IGHJ4*01 | 1974 |
| 157 | gnl\|Fabrus\|VH3-23__IGHD6-25*01__IGHJ2*01 | 1975 |
| 158 | gnl\|Fabrus\|VH3-23__IGHD6-6*01__IGHJ1*01 | 1976 |
| 159 | gnl\|Fabrus\|VH3-23__IGHD7-27*01__IGHJ4*01 | 1977 |
| 160 | gnl\|Fabrus\|VH3-23__IGHD7-27*01__IGHJ6*01 | 1978 |
| 161 | gnl\|Fabrus\|VH3-30__IGHD1-1*01__IGHJ6*01 | 1979 |
| 162 | gnl\|Fabrus\|VH3-30__IGHD1-26*01__IGHJ1*01 | 1980 |
| 163 | gnl\|Fabrus\|VH3-30__IGHD1-26*01__IGHJ4*01 | 1981 |
| 164 | gnl\|Fabrus\|VH3-30__IGHD2-15*01__IGHJ2*01 | 1982 |
| 165 | gnl\|Fabrus\|VH3-30__IGHD2-2*01__IGHJ6*01 | 1983 |
| 166 | gnl\|Fabrus\|VH3-30__IGHD3-10*01__IGHJ1*01 | 1984 |
| 167 | gnl\|Fabrus\|VH3-30__IGHD3-16*01__IGHJ6*01 | 1985 |
| 168 | gnl\|Fabrus\|VH3-30__IGHD4-17*01__IGHJ4*01 | 1986 |
| 169 | gnl\|Fabrus\|VH3-30__IGHD5-12*01__IGHJ4*01 | 1987 |
| 170 | gnl\|Fabrus\|VH3-30__IGHD5-18*01__IGHJ1*01 | 1988 |
| 171 | gnl\|Fabrus\|VH3-30__IGHD6-13*01__IGHJ4*01 | 1989 |
| 172 | gnl\|Fabrus\|VH3-30__IGHD6-6*01__IGHJ1*01 | 1990 |
| 173 | gnl\|Fabrus\|VH3-35__IGHD1-1*01__IGHJ2*01 | 1991 |
| 174 | gnl\|Fabrus\|VH3-35__IGHD1-20*01__IGHJ6*01 | 1992 |
| 175 | gnl\|Fabrus\|VH3-35__IGHD2-15*01__IGHJ2*01 | 1993 |
| 176 | gnl\|Fabrus\|VH3-35__IGHD2-21*01__IGHJ6*01 | 1994 |
| 177 | gnl\|Fabrus\|VH3-35__IGHD3-10*01__IGHJ4*01 | 1995 |
| 178 | gnl\|Fabrus\|VH3-35__IGHD3-9*01__IGHJ6*01 | 1996 |
| 179 | gnl\|Fabrus\|VH3-35__IGHD5-12*01__IGHJ4*01 | 1997 |
| 180 | gnl\|Fabrus\|VH3-35__IGHD6-13*01__IGHJ4*01 | 1998 |
| 181 | gnl\|Fabrus\|VH3-35__IGHD7-27*01__IGHJ1*01 | 1999 |
| 182 | gnl\|Fabrus\|VH3-38__IGHD1-14*01__IGHJ5*01 | 2000 |
| 183 | gnl\|Fabrus\|VH3-38__IGHD1-20*01__IGHJ6*01 | 2001 |
| 184 | gnl\|Fabrus\|VH3-38__IGHD2-15*01__IGHJ6*01 | 2002 |
| 185 | gnl\|Fabrus\|VH3-38__IGHD2-2*01__IGHJ1*01 | 2003 |
| 186 | gnl\|Fabrus\|VH3-38__IGHD3-10*01__IGHJ4*01 | 2004 |
| 187 | gnl\|Fabrus\|VH3-38__IGHD3-16*01__IGHJ1*01 | 2005 |
| 188 | gnl\|Fabrus\|VH3-38__IGHD4-17*01__IGHJ2*01 | 2006 |
| 189 | gnl\|Fabrus\|VH3-38__IGHD5-24*01__IGHJ3*01 | 2007 |
| 190 | gnl\|Fabrus\|VH3-38__IGHD6-6*01__IGHJ1*01 | 2008 |
| 191 | gnl\|Fabrus\|VH3-38__IGHD7-27*01__IGHJ6*01 | 2009 |
| 192 | gnl\|Fabrus\|VH3-43__IGHD1-26*01__IGHJ5*01 | 2010 |
| 193 | gnl\|Fabrus\|VH3-43__IGHD1-7*01__IGHJ6*01 | 2011 |
| 194 | gnl\|Fabrus\|VH3-43__IGHD2-2*01__IGHJ3*01 | 2012 |
| 195 | gnl\|Fabrus\|VH3-43__IGHD2-21*01__IGHJ6*01 | 2013 |
| 196 | gnl\|Fabrus\|VH3-43__IGHD3-16*01__IGHJ6*01 | 2014 |
| 197 | gnl\|Fabrus\|VH3-43__IGHD3-22*01__IGHJ4*01 | 2015 |
| 198 | gnl\|Fabrus\|VH3-43__IGHD4-23*01__IGHJ3*01 | 2016 |
| 199 | gnl\|Fabrus\|VH3-43__IGHD5-18*01__IGHJ5*01 | 2017 |
| 200 | gnl\|Fabrus\|VH3-43__IGHD6-13*01__IGHJ4*01 | 2018 |
| 201 | gnl\|Fabrus\|VH3-43__IGHD7-27*01__IGHJ1*01 | 2019 |
| 202 | gnl\|Fabrus\|VH3-48__IGHD6-6*01__IGHJ1*01 | 2020 |
| 203 | gnl\|Fabrus\|VH3-49__IGHD1-26*01__IGHJ4*01 | 2021 |
| 204 | gnl\|Fabrus\|VH3-49__IGHD1-7*01__IGHJ6*01 | 2022 |
| 205 | gnl\|Fabrus\|VH3-49__IGHD2-2*01__IGHJ6*01 | 2023 |
| 206 | gnl\|Fabrus\|VH3-49__IGHD2-8*01__IGHJ4*01 | 2024 |
| 207 | gnl\|Fabrus\|VH3-49__IGHD3-22*01__IGHJ4*01 | 2025 |
| 208 | gnl\|Fabrus\|VH3-49__IGHD3-9*01__IGHJ6*01 | 2026 |
| 209 | gnl\|Fabrus\|VH3-49__IGHD5-18*01__IGHJ4*01 | 2027 |
| 210 | gnl\|Fabrus\|VH3-49__IGHD6-13*01__IGHJ4*01 | 2028 |
| 211 | gnl\|Fabrus\|VH3-49__IGHD7-27*01__IGHJ1*01 | 2029 |
| 212 | gnl\|Fabrus\|VH3-53__IGHD1-14*01__IGHJ6*01 | 2030 |
| 213 | gnl\|Fabrus\|VH3-53__IGHD1-7*01__IGHJ1*01 | 2031 |
| 214 | gnl\|Fabrus\|VH3-53__IGHD2-2*01__IGHJ2*01 | 2032 |
| 215 | gnl\|Fabrus\|VH3-53__IGHD3-22*01__IGHJ3*01 | 2033 |
| 216 | gnl\|Fabrus\|VH3-53__IGHD4-23*01__IGHJ1*01 | 2034 |
| 217 | gnl\|Fabrus\|VH3-53__IGHD5-5*01__IGHJ4*01 | 2035 |
| 218 | gnl\|Fabrus\|VH3-53__IGHD6-13*01__IGHJ3*01 | 2036 |
| 219 | gnl\|Fabrus\|VH3-53__IGHD7-27*01__IGHJ4*01 | 2037 |
| 220 | gnl\|Fabrus\|VH3-64__IGHD1-26*01__IGHJ4*01 | 2038 |
| 221 | gnl\|Fabrus\|VH3-64__IGHD1-7*01__IGHJ6*01 | 2039 |
| 222 | gnl\|Fabrus\|VH3-64__IGHD2-2*01__IGHJ5*01 | 2040 |
| 223 | gnl\|Fabrus\|VH3-64__IGHD3-3*01__IGHJ4*01 | 2041 |
| 224 | gnl\|Fabrus\|VH3-64__IGHD4-17*01__IGHJ4*01 | 2042 |
| 225 | gnl\|Fabrus\|VH3-64__IGHD5-12*01__IGHJ4*01 | 2043 |
| 226 | gnl\|Fabrus\|VH3-64__IGHD6-19*01__IGHJ1*01 | 2044 |
| 227 | gnl\|Fabrus\|VH3-64__IGHD7-27*01__IGHJ4*01 | 2045 |
| 228 | gnl\|Fabrus\|VH3-66__IGHD6-6*01__IGHJ1*01 | 2046 |
| 229 | gnl\|Fabrus\|VH3-7__IGHD1-20*01__IGHJ3*01 | 2047 |
| 230 | gnl\|Fabrus\|VH3-7__IGHD1-7*01__IGHJ6*01 | 2048 |
| 231 | gnl\|Fabrus\|VH3-7__IGHD2-21*01__IGHJ5*01 | 2049 |
| 232 | gnl\|Fabrus\|VH3-7__IGHD2-8*01__IGHJ6*01 | 2050 |
| 233 | gnl\|Fabrus\|VH3-7__IGHD3-22*01__IGHJ3*01 | 2051 |
| 234 | gnl\|Fabrus\|VH3-7__IGHD3-9*01__IGHJ6*01 | 2052 |
| 235 | gnl\|Fabrus\|VH3-7__IGHD4-17*01__IGHJ4*01 | 2053 |
| 236 | gnl\|Fabrus\|VH3-7__IGHD5-12*01__IGHJ4*01 | 2054 |
| 237 | gnl\|Fabrus\|VH3-7__IGHD5-24*01__IGHJ4*01 | 2055 |
| 238 | gnl\|Fabrus\|VH3-7__IGHD6-19*01__IGHJ6*01 | 2056 |
| 239 | gnl\|Fabrus\|VH3-7__IGHD6-6*01__IGHJ1*01 | 2057 |
| 240 | gnl\|Fabrus\|VH3-7__IGHD7-27*01__IGHJ2*01 | 2058 |
| 241 | gnl\|Fabrus\|VH3-72__IGHD1-1*01__IGHJ4*01 | 2059 |
| 242 | gnl\|Fabrus\|VH3-72__IGHD2-15*01__IGHJ1*01 | 2060 |
| 243 | gnl\|Fabrus\|VH3-72__IGHD3-22*01__IGHJ4*01 | 2061 |
| 244 | gnl\|Fabrus\|VH3-72__IGHD3-9*01__IGHJ6*01 | 2062 |
| 245 | gnl\|Fabrus\|VH3-72__IGHD4-23*01__IGHJ2*01 | 2063 |
| 246 | gnl\|Fabrus\|VH3-72__IGHD5-18*01__IGHJ4*01 | 2064 |
| 247 | gnl\|Fabrus\|VH3-72__IGHD5-24*01__IGHJ6*01 | 2065 |
| 248 | gnl\|Fabrus\|VH3-72__IGHD6-6*01__IGHJ1*01 | 2066 |
| 249 | gnl\|Fabrus\|VH3-72__IGHD7-27*01__IGHJ2*01 | 2067 |
| 250 | gnl\|Fabrus\|VH3-73__IGHD1-1*01__IGHJ5*01 | 2068 |
| 251 | gnl\|Fabrus\|VH3-73__IGHD2-8*01__IGHJ2*01 | 2069 |
| 252 | gnl\|Fabrus\|VH3-73__IGHD3-22*01__IGHJ4*01 | 2070 |
| 253 | gnl\|Fabrus\|VH3-73__IGHD3-9*01__IGHJ6*01 | 2071 |
| 254 | gnl\|Fabrus\|VH3-73__IGHD4-11*01__IGHJ6*01 | 2072 |
| 255 | gnl\|Fabrus\|VH3-73__IGHD4-23*01__IGHJ5*01 | 2073 |
| 256 | gnl\|Fabrus\|VH3-73__IGHD5-12*01__IGHJ4*01 | 2074 |
| 257 | gnl\|Fabrus\|VH3-73__IGHD6-19*01__IGHJ1*01 | 2075 |
| 258 | gnl\|Fabrus\|VH3-73__IGHD7-27*01__IGHJ5*01 | 2076 |
| 259 | gnl\|Fabrus\|VH3-74__IGHD1-1*01__IGHJ6*01 | 2077 |
| 260 | gnl\|Fabrus\|VH3-74__IGHD1-26*01__IGHJ4*01 | 2078 |
| 261 | gnl\|Fabrus\|VH3-74__IGHD2-2*01__IGHJ5*01 | 2079 |
| 262 | gnl\|Fabrus\|VH3-74__IGHD3-22*01__IGHJ5*01 | 2080 |
| 263 | gnl\|Fabrus\|VH3-74__IGHD4-17*01__IGHJ1*01 | 2081 |
| 264 | gnl\|Fabrus\|VH3-74__IGHD5-12*01__IGHJ4*01 | 2082 |
| 265 | gnl\|Fabrus\|VH3-74__IGHD6-6*01__IGHJ1*01 | 2083 |

TABLE 3-continued

Exemplary Variable Heavy Chains and Light Chains

| Number | Name | SEQ ID NO. |
|---|---|---|
| 266 | gnl\|Fabrus\|VH3-74__IGHD7-27*01__IGHJ4*01 | 2084 |
| 267 | gnl\|Fabrus\|VH3-9__IGHD1-1*01__IGHJ6*01 | 2085 |
| 268 | gnl\|Fabrus\|VH3-9__IGHD1-7*01__IGHJ5*01 | 2086 |
| 269 | gnl\|Fabrus\|VH3-9__IGHD2-2*01__IGHJ4*01 | 2087 |
| 270 | gnl\|Fabrus\|VH3-9__IGHD3-16*01__IGHJ6*01 | 2088 |
| 271 | gnl\|Fabrus\|VH3-9__IGHD3-22*01__IGHJ4*01 | 2089 |
| 272 | gnl\|Fabrus\|VH3-9__IGHD4-11*01__IGHJ6*01 | 2090 |
| 273 | gnl\|Fabrus\|VH3-9__IGHD5-24*01__IGHJ1*01 | 2091 |
| 274 | gnl\|Fabrus\|VH3-9__IGHD6-13*01__IGHJ4*01 | 2092 |
| 275 | gnl\|Fabrus\|VH3-9__IGHD6-25*01__IGHJ6*01 | 2093 |
| 276 | gnl\|Fabrus\|VH3-9__IGHD7-27*01__IGHJ2*01 | 2094 |
| 277 | gnl\|Fabrus\|VH4-28__IGHD1-20*01__IGHJ1*01 | 2095 |
| 278 | gnl\|Fabrus\|VH4-28__IGHD1-7*01__IGHJ6*01 | 2096 |
| 279 | gnl\|Fabrus\|VH4-28__IGHD2-15*01__IGHJ6*01 | 2097 |
| 280 | gnl\|Fabrus\|VH4-28__IGHD3-16*01__IGHJ2*01 | 2098 |
| 281 | gnl\|Fabrus\|VH4-28__IGHD3-9*01__IGHJ6*01 | 2099 |
| 282 | gnl\|Fabrus\|VH4-28__IGHD4-4*01__IGHJ4*01 | 2100 |
| 283 | gnl\|Fabrus\|VH4-28__IGHD5-5*01__IGHJ1*01 | 2101 |
| 284 | gnl\|Fabrus\|VH4-28__IGHD6-13*01__IGHJ4*01 | 2102 |
| 285 | gnl\|Fabrus\|VH4-28__IGHD7-27*01__IGHJ1*01 | 94 |
| 286 | gnl\|Fabrus\|VH4-31__IGHD1-26*01__IGHJ2*01 | 91 |
| 287 | gnl\|Fabrus\|VH4-31__IGHD2-15*01__IGHJ2*01 | 103 |
| 288 | gnl\|Fabrus\|VH4-31__IGHD2-2*01__IGHJ6*01 | 2103 |
| 289 | gnl\|Fabrus\|VH4-31__IGHD3-10*01__IGHJ4*01 | 2104 |
| 290 | gnl\|Fabrus\|VH4-31__IGHD3-9*01__IGHJ6*01 | 2105 |
| 291 | gnl\|Fabrus\|VH4-31__IGHD4-17*01__IGHJ5*01 | 2106 |
| 292 | gnl\|Fabrus\|VH4-31__IGHD5-12*01__IGHJ4*01 | 2107 |
| 293 | gnl\|Fabrus\|VH4-31__IGHD6-13*01__IGHJ4*01 | 2108 |
| 294 | gnl\|Fabrus\|VH4-31__IGHD6-6*01__IGHJ1*01 | 2109 |
| 295 | gnl\|Fabrus\|VH4-31__IGHD7-27*01__IGHJ5*01 | 95 |
| 296 | gnl\|Fabrus\|VH4-34__IGHD1-7*01__IGHJ4*01 | 2110 |
| 297 | gnl\|Fabrus\|VH4-34__IGHD2-2*01__IGHJ4*01 | 2111 |
| 298 | gnl\|Fabrus\|VH4-34__IGHD3-16*01__IGHJ4*01 | 2112 |
| 299 | gnl\|Fabrus\|VH4-34__IGHD3-22*01__IGHJ6*01 | 2113 |
| 300 | gnl\|Fabrus\|VH4-34__IGHD4-17*01__IGHJ4*01 | 2114 |
| 301 | gnl\|Fabrus\|VH4-34__IGHD5-12*01__IGHJ4*01 | 2115 |
| 302 | gnl\|Fabrus\|VH4-34__IGHD6-13*01__IGHJ4*01 | 2116 |
| 303 | gnl\|Fabrus\|VH4-34__IGHD6-25*01__IGHJ6*01 | 2117 |
| 304 | gnl\|Fabrus\|VH4-34__IGHD6-6*01__IGHJ6*01 | 2118 |
| 305 | gnl\|Fabrus\|VH4-34__IGHD7-27*01__IGHJ4*01 | 100 |
| 306 | gnl\|Fabrus\|VH4-39__IGHD1-14*01__IGHJ1*01 | 2119 |
| 307 | gnl\|Fabrus\|VH4-39__IGHD1-20*01__IGHJ6*01 | 2120 |
| 308 | gnl\|Fabrus\|VH4-39__IGHD2-21*01__IGHJ3*01 | 2121 |
| 309 | gnl\|Fabrus\|VH4-39__IGHD3-10*01__IGHJ4*01 | 2122 |
| 310 | gnl\|Fabrus\|VH4-39__IGHD3-16*01__IGHJ2*01 | 2123 |
| 311 | gnl\|Fabrus\|VH4-39__IGHD3-9*01__IGHJ6*01 | 2124 |
| 312 | gnl\|Fabrus\|VH4-39__IGHD4-23*01__IGHJ2*01 | 2125 |
| 313 | gnl\|Fabrus\|VH4-39__IGHD5-12*01__IGHJ4*01 | 2126 |
| 314 | gnl\|Fabrus\|VH4-39__IGHD6-6*01__IGHJ1*01 | 2127 |
| 315 | gnl\|Fabrus\|VH4-4__IGHD1-20*01__IGHJ3*01 | 2128 |
| 316 | gnl\|Fabrus\|VH4-4__IGHD2-8*01__IGHJ4*01 | 2129 |
| 317 | gnl\|Fabrus\|VH4-4__IGHD3-22*01__IGHJ2*01 | 2130 |
| 318 | gnl\|Fabrus\|VH4-4__IGHD4-23*01__IGHJ4*01 | 2131 |
| 319 | gnl\|Fabrus\|VH4-4__IGHD5-12*01__IGHJ5*01 | 2132 |
| 320 | gnl\|Fabrus\|VH4-4__IGHD6-6*01__IGHJ4*01 | 2133 |
| 321 | gnl\|Fabrus\|VH4-4__IGHD7-27*01__IGHJ6*01 | 2134 |
| 322 | gnl\|Fabrus\|VH4-59__IGHD6-25*01__IGHJ3*01 | 2135 |
| 323 | gnl\|Fabrus\|VH5-51__IGHD1-14*01__IGHJ4*01 | 2136 |
| 324 | gnl\|Fabrus\|VH5-51__IGHD1-26*01__IGHJ6*01 | 2137 |
| 325 | gnl\|Fabrus\|VH5-51__IGHD2-8*01__IGHJ4*01 | 2138 |
| 326 | gnl\|Fabrus\|VH5-51__IGHD3-10*01__IGHJ6*01 | 2139 |
| 327 | gnl\|Fabrus\|VH5-51__IGHD3-3*01__IGHJ4*01 | 2140 |
| 328 | gnl\|Fabrus\|VH5-51__IGHD4-17*01__IGHJ4*01 | 2141 |
| 329 | gnl\|Fabrus\|VH5-51__IGHD5-18*01 > 3__IGHJ4*01 | 89 |
| 330 | gnl\|Fabrus\|VH5-51__IGHD5-18*01 > 1__IGHJ4*01 | 2142 |
| 331 | gnl\|Fabrus\|VH5-51__IGHD6-25*01__IGHJ4*01 | 106 |
| 332 | gnl\|Fabrus\|VH5-51__IGHD7-27*01__IGHJ4*01 | 2143 |
| 333 | gnl\|Fabrus\|VH6-1__IGHD1-1*01__IGHJ4*01 | 2144 |
| 334 | gnl\|Fabrus\|VH6-1__IGHD1-20*01__IGHJ6*01 | 2145 |
| 335 | gnl\|Fabrus\|VH6-1__IGHD2-15*01__IGHJ4*01 | 2146 |
| 336 | gnl\|Fabrus\|VH6-1__IGHD2-21*01__IGHJ6*01 | 2147 |
| 337 | gnl\|Fabrus\|VH6-1__IGHD3-16*01__IGHJ5*01 | 2148 |
| 338 | gnl\|Fabrus\|VH6-1__IGHD3-3*01__IGHJ4*01 | 90 |
| 339 | gnl\|Fabrus\|VH6-1__IGHD4-11*01__IGHJ6*01 | 2149 |
| 340 | gnl\|Fabrus\|VH6-1__IGHD4-23*01__IGHJ4*01 | 2150 |
| 341 | gnl\|Fabrus\|VH6-1__IGHD5-5*01__IGHJ4*01 | 2151 |
| 342 | gnl\|Fabrus\|VH6-1__IGHD6-13*01__IGHJ4*01 | 2152 |
| 343 | gnl\|Fabrus\|VH6-1__IGHD6-25*01__IGHJ6*01 | 2153 |
| 344 | gnl\|Fabrus\|VH6-1__IGHD7-27*01__IGHJ4*01 | 2154 |
| 345 | gnl\|Fabrus\|VH7-81__IGHD1-14*01__IGHJ4*01 | 2155 |
| 346 | gnl\|Fabrus\|VH7-81__IGHD2-21*01__IGHJ2*01 | 2156 |
| 347 | gnl\|Fabrus\|VH7-81__IGHD2-21*01__IGHJ6*01 | 2157 |
| 348 | gnl\|Fabrus\|VH7-81__IGHD3-16*01__IGHJ6*01 | 2158 |
| 349 | gnl\|Fabrus\|VH7-81__IGHD4-23*01__IGHJ1*01 | 2159 |
| 350 | gnl\|Fabrus\|VH7-81__IGHD5-12*01__IGHJ6*01 | 2160 |
| 351 | gnl\|Fabrus\|VH7-81__IGHD6-25*01__IGHJ4*01 | 2161 |
| 352 | gnl\|Fabrus\|VH7-81__IGHD7-27*01__IGHJ4*01 | 2162 |
| 353 | gi\|Fabrus\|VH3-23__IGHD1-1*01 > 1__IGHJ1*01 | 2211 |
| 355 | gi\|Fabrus\|VH3-23__IGHD1-1*01 > 2__IGHJ1*01 | 2212 |
| 356 | gi\|Fabrus\|VH3-23__IGHD1-1*01 > 3__IGHJ1*01 | 2213 |
| 357 | gi\|Fabrus\|VH3-23__IGHD1-7*01 > 1__IGHJ1*01 | 2214 |
| 358 | gi\|Fabrus\|VH3-23__IGHD1-7*01 > 3__IGHJ1*01 | 2215 |
| 359 | gi\|Fabrus\|VH3-23__IGHD1-14*01 > 1__IGHJ1*01 | 2216 |
| 360 | gi\|Fabrus\|VH3-23__IGHD1-14*01 > 3__IGHJ1*01 | 2217 |
| 361 | gi\|Fabrus\|VH3-23__IGHD1-20*01 > 1__IGHJ1*01 | 2218 |
| 362 | gi\|Fabrus\|VH3-23__IGHD1-20*01 > 3__IGHJ1*01 | 2219 |
| 363 | gi\|Fabrus\|VH3-23__IGHD1-26*01 > 1__IGHJ1*01 | 2220 |
| 364 | gi\|Fabrus\|VH3-23__IGHD1-26*01 > 3__IGHJ1*01 | 2221 |
| 365 | gi\|Fabrus\|VH3-23__IGHD2-2*01 > 2__IGHJ1*01 | 2222 |
| 366 | gi\|Fabrus\|VH3-23__IGHD2-2*01 > 3__IGHJ1*01 | 2223 |
| 367 | gi\|Fabrus\|VH3-23__IGHD2-8*01 > 2__IGHJ1*01 | 2224 |
| 368 | gi\|Fabrus\|VH3-23__IGHD2-8*01 > 3__IGHJ1*01 | 2225 |
| 369 | gi\|Fabrus\|VH3-23__IGHD2-15*01 > 2__IGHJ1*01 | 2226 |
| 370 | gi\|Fabrus\|VH3-23__IGHD2-15*01 > 3__IGHJ1*01 | 2227 |
| 371 | gi\|Fabrus\|VH3-23__IGHD2-21*01 > 2__IGHJ1*01 | 2228 |
| 372 | gi\|Fabrus\|VH3-23__IGHD2-21*01 > 3__IGHJ1*01 | 2229 |
| 373 | gi\|Fabrus\|VH3-23__IGHD3-3*01 > 1__IGHJ1*01 | 2230 |
| 374 | gi\|Fabrus\|VH3-23__IGHD3-3*01 > 2__IGHJ1*01 | 2231 |
| 375 | gi\|Fabrus\|VH3-23__IGHD3-3*01 > 3__IGHJ1*01 | 2232 |
| 376 | gi\|Fabrus\|VH3-23__IGHD3-9*01 > 2__IGHJ1*01 | 2233 |
| 377 | gi\|Fabrus\|VH3-23__IGHD3-10*01 > 2__IGHJ1*01 | 2234 |
| 378 | gi\|Fabrus\|VH3-23__IGHD3-10*01 > 3__IGHJ1*01 | 2235 |
| 379 | gi\|Fabrus\|VH3-23__IGHD3-16*01 > 2__IGHJ1*01 | 2236 |
| 380 | gi\|Fabrus\|VH3-23__IGHD3-16*01 > 3__IGHJ1*01 | 2237 |
| 381 | gi\|Fabrus\|VH3-23__IGHD3-22*01 > 2__IGHJ1*01 | 2238 |
| 382 | gi\|Fabrus\|VH3-23__IGHD3-22*01 > 3__IGHJ1*01 | 2239 |
| 383 | gi\|Fabrus\|VH3-23__IGHD4-4*01(1) > 2__IGHJ1*01 | 2240 |
| 384 | gi\|Fabrus\|VH3-23__IGHD4-4*01(1) > 3__IGHJ1*01 | 2241 |
| 385 | gi\|Fabrus\|VH3-23__IGHD4-11*01(1) > 2__IGHJ1*01 | 2242 |
| 386 | gi\|Fabrus\|VH3-23__IGHD4-11*01(1) > 3__IGHJ1*01 | 2243 |
| 387 | gi\|Fabrus\|VH3-23__IGHD4-17*01 > 2__IGHJ1*01 | 2244 |
| 388 | gi\|Fabrus\|VH3-23__IGHD4-17*01 > 3__IGHJ1*01 | 2245 |
| 389 | gi\|Fabrus\|VH3-23__IGHD4-23*01 > 2__IGHJ1*01 | 2246 |
| 390 | gi\|Fabrus\|VH3-23__IGHD4-23*01 > 3__IGHJ1*01 | 2247 |
| 391 | gi\|Fabrus\|VH3-23__IGHD5-5*01(2) > 1__IGHJ1*01 | 2248 |
| 392 | gi\|Fabrus\|VH3-23__IGHD5-5*01(2) > 2__IGHJ1*01 | 2249 |
| 393 | gi\|Fabrus\|VH3-23__IGHD5-5*01(2) > 3__IGHJ1*01 | 2250 |
| 394 | gi\|Fabrus\|VH3-23__IGHD5-12*01 > 1__IGHJ1*01 | 2251 |
| 395 | gi\|Fabrus\|VH3-23__IGHD5-12*01 > 3__IGHJ1*01 | 2252 |
| 396 | gi\|Fabrus\|VH3-23__IGHD5-18*01(2) > 1__IGHJ1*01 | 2253 |
| 397 | gi\|Fabrus\|VH3-23__IGHD5-18*01(2) > 2__IGHJ1*01 | 2254 |
| 398 | gi\|Fabrus\|VH3-23__IGHD5-18*01(2) > 3__IGHJ1*01 | 2255 |
| 399 | gi\|Fabrus\|VH3-23__IGHD5-24*01 > 1__IGHJ1*01 | 2256 |
| 400 | gi\|Fabrus\|VH3-23__IGHD5-24*01 > 3__IGHJ1*01 | 2257 |
| 401 | gi\|Fabrus\|VH3-23__IGHD6-6*01 > 1__IGHJ1*01 | 2258 |
| 402 | gi\|Fabrus\|VH3-23__IGHD6-6*01 > 2__IGHJ1*01 | 2259 |
| 403 | gi\|Fabrus\|VH3-23__IGHD6-13*01 > 1__IGHJ1*01 | 2260 |
| 404 | gi\|Fabrus\|VH3-23__IGHD6-13*01 > 2__IGHJ1*01 | 2261 |
| 405 | gi\|Fabrus\|VH3-23__IGHD6-19*01 > 1__IGHJ1*01 | 2262 |
| 406 | gi\|Fabrus\|VH3-23__IGHD6-19*01 > 2__IGHJ1*01 | 2263 |
| 407 | gi\|Fabrus\|VH3-23__IGHD6-25*01 > 1__IGHJ1*01 | 2264 |
| 408 | gi\|Fabrus\|VH3-23__IGHD6-25*01 > 2__IGHJ1*01 | 2265 |
| 409 | gi\|Fabrus\|VH3-23__IGHD7-27*01 > 1__IGHJ1*01 | 2266 |
| 410 | gi\|Fabrus\|VH3-23__IGHD7-27*01 > 3__IGHJ1*01 | 2267 |
| 411 | gi\|Fabrus\|VH3-23__IGHD1-1*01 > 2'__IGHJ1*01 | 2268 |
| 412 | gi\|Fabrus\|VH3-23__IGHD1-1*01 > 2'__IGHJ1*01 | 2269 |
| 413 | gi\|Fabrus\|VH3-23__IGHD1-1*01 > 3'__IGHJ1*01 | 2270 |
| 414 | gi\|Fabrus\|VH3-23__IGHD1-7*01 > 1'__IGHJ1*01 | 2271 |
| 415 | gi\|Fabrus\|VH3-23__IGHD1-7*01 > 3'__IGHJ1*01 | 2272 |
| 416 | gi\|Fabrus\|VH3-23__IGHD1-14*01 > 1'__IGHJ1*01 | 2273 |

TABLE 3-continued

Exemplary Variable Heavy Chains and Light Chains

| Number | Name | SEQ ID NO. |
|---|---|---|
| 417 | gi\|Fabrus\|VH3-23__IGHD1-14*01 > 2'__IGHJ1*01 | 2274 |
| 418 | gi\|Fabrus\|VH3-23__IGHD1-14*01 > 3'__IGHJ1*01 | 2275 |
| 419 | gi\|Fabrus\|VH3-23__IGHD1-20*01 > 1'__IGHJ1*01 | 2276 |
| 420 | gi\|Fabrus\|VH3-23__IGHD1-20*01 > 2'__IGHJ1*01 | 2277 |
| 421 | gi\|Fabrus\|VH3-23__IGHD1-20*01 > 3'__IGHJ1*01 | 2278 |
| 422 | gi\|Fabrus\|VH3-23__IGHD1-26*01 > 1'__IGHJ1*01 | 2279 |
| 423 | gi\|Fabrus\|VH3-23__IGHD1-26*01 > 3'__IGHJ1*01 | 2280 |
| 424 | gi\|Fabrus\|VH3-23__IGHD2-2*01 > 1'__IGHJ1*01 | 2281 |
| 425 | gi\|Fabrus\|VH3-23__IGHD2-2*01 > 3'__IGHJ1*01 | 2282 |
| 426 | gi\|Fabrus\|VH3-23__IGHD2-8*01 > 1'__IGHJ1*01 | 2283 |
| 427 | gi\|Fabrus\|VH3-23__IGHD2-15*01 > 1'__IGHJ1*01 | 2284 |
| 428 | gi\|Fabrus\|VH3-23__IGHD2-15*01 > 3'__IGHJ1*01 | 2285 |
| 429 | gi\|Fabrus\|VH3-23__IGHD2-21*01 > 1'__IGHJ1*01 | 2286 |
| 430 | gi\|Fabrus\|VH3-23__IGHD2-21*01 > 3'__IGHJ1*01 | 2287 |
| 431 | gi\|Fabrus\|VH3-23__IGHD3-3*01 > 1'__IGHJ1*01 | 2288 |
| 432 | gi\|Fabrus\|VH3-23__IGHD3-3*01 > 3'__IGHJ1*01 | 2289 |
| 433 | gi\|Fabrus\|VH3-23__IGHD3-9*01 > 1'__IGHJ1*01 | 2290 |
| 434 | gi\|Fabrus\|VH3-23__IGHD3-9*01 > 3'__IGHJ1*01 | 2291 |
| 435 | gi\|Fabrus\|VH3-23__IGHD3-10*01 > 1'__IGHJ1*01 | 2292 |
| 436 | gi\|Fabrus\|VH3-23__IGHD3-10*01 > 3'__IGHJ1*01 | 2293 |
| 437 | gi\|Fabrus\|VH3-23__IGHD3-16*01 > 1'__IGHJ1*01 | 2294 |
| 438 | gi\|Fabrus\|VH3-23__IGHD3-16*01 > 3'__IGHJ1*01 | 2295 |
| 439 | gi\|Fabrus\|VH3-23__IGHD3-22*01 > 1'__IGHJ1*01 | 2296 |
| 440 | gi\|Fabrus\|VH3-23__IGHD4-4*01(1) > 1'__IGHJ1*01 | 2297 |
| 441 | gi\|Fabrus\|VH3-23__IGHD4-4*01(1) > 3'__IGHJ1*01 | 2298 |
| 442 | gi\|Fabrus\|VH3-23__IGHD4-11*01(1) > 1'__IGHJ1*01 | 2299 |
| 443 | gi\|Fabrus\|VH3-23__IGHD4-11*01(1) > 3'__IGHJ1*01 | 2300 |
| 444 | gi\|Fabrus\|VH3-23__IGHD4-17*01 > 1'__IGHJ1*01 | 2301 |
| 445 | gi\|Fabrus\|VH3-23__IGHD4-17*01 > 3'__IGHJ1*01 | 2302 |
| 446 | gi\|Fabrus\|VH3-23__IGHD4-23*01 > 1'__IGHJ1*01 | 2303 |
| 447 | gi\|Fabrus\|VH3-23__IGHD4-23*01 > 3'__IGHJ1*01 | 2304 |
| 448 | gi\|Fabrus\|VH3-23__IGHD5-5*01(2) > 1'__IGHJ1*01 | 2305 |
| 449 | gi\|Fabrus\|VH3-23__IGHD5-5*01(2) > 3'__IGHJ1*01 | 2306 |
| 450 | gi\|Fabrus\|VH3-23__IGHD5-12*01 > 1'__IGHJ1*01 | 2307 |
| 451 | gi\|Fabrus\|VH3-23__IGHD5-12*01 > 3'__IGHJ1*01 | 2308 |
| 452 | gi\|Fabrus\|VH3-23__IGHD5-18*01(2) > 1'__IGHJ1*01 | 2309 |
| 453 | gi\|Fabrus\|VH3-23__IGHD5-18*01(2) > 3'__IGHJ1*01 | 2310 |
| 454 | gi\|Fabrus\|VH3-23__IGHD5-24*01 > 1'__IGHJ1*01 | 2311 |
| 455 | gi\|Fabrus\|VH3-23__IGHD5-24*01 > 3'__IGHJ1*01 | 2312 |
| 456 | gi\|Fabrus\|VH3-23__IGHD6-6*01 > 1'__IGHJ1*01 | 2313 |
| 457 | gi\|Fabrus\|VH3-23__IGHD6-6*01 > 2'__IGHJ1*01 | 2314 |
| 458 | gi\|Fabrus\|VH3-23__IGHD6-6*01 > 3'__IGHJ1*01 | 2315 |
| 459 | gi\|Fabrus\|VH3-23__IGHD6-13*01 > 1'__IGHJ1*01 | 2316 |
| 460 | gi\|Fabrus\|VH3-23__IGHD6-13*01 > 2'__IGHJ1*01 | 2317 |
| 461 | gi\|Fabrus\|VH3-23__IGHD6-13*01 > 3'__IGHJ1*01 | 2318 |
| 462 | gi\|Fabrus\|VH3-23__IGHD6-19*01 > 1'__IGHJ1*01 | 2319 |
| 463 | gi\|Fabrus\|VH3-23__IGHD6-19*01 > 2'__IGHJ1*01 | 2320 |
| 464 | gi\|Fabrus\|VH3-23__IGHD6-19*01 > 3'__IGHJ1*01 | 2321 |
| 465 | gi\|Fabrus\|VH3-23__IGHD6-25*01 > 1'__IGHJ1*01 | 2322 |
| 466 | gi\|Fabrus\|VH3-23__IGHD6-25*01 > 3'__IGHJ1*01 | 2323 |
| 467 | gi\|Fabrus\|VH3-23__IGHD7-27*01 > 1'__IGHJ1*01 | 2324 |
| 468 | gi\|Fabrus\|VH3-23__IGHD7-27*01 > 2'__IGHJ1*01 | 2325 |
| 469 | gi\|Fabrus\|VH3-23__IGHD1-1*01 > 1__IGHJ2*01 | 2326 |
| 470 | gi\|Fabrus\|VH3-23__IGHD1-1*01 > 2__IGHJ2*01 | 2327 |
| 471 | gi\|Fabrus\|VH3-23__IGHD1-1*01 > 3__IGHJ2*01 | 2328 |
| 472 | gi\|Fabrus\|VH3-23__IGHD1-7*01 > 1__IGHJ2*01 | 2329 |
| 473 | gi\|Fabrus\|VH3-23__IGHD1-7*01 > 3__IGHJ2*01 | 2330 |
| 474 | gi\|Fabrus\|VH3-23__IGHD1-14*01 > 1__IGHJ2*01 | 2331 |
| 475 | gi\|Fabrus\|VH3-23__IGHD1-14*01 > 3__IGHJ2*01 | 2332 |
| 476 | gi\|Fabrus\|VH3-23__IGHD1-20*01 > 1__IGHJ2*01 | 2333 |
| 477 | gi\|Fabrus\|VH3-23__IGHD1-20*01 > 3__IGHJ2*01 | 2334 |
| 478 | gi\|Fabrus\|VH3-23__IGHD1-26*01 > 1__IGHJ2*01 | 2335 |
| 479 | gi\|Fabrus\|VH3-23__IGHD1-26*01 > 3__IGHJ2*01 | 2336 |
| 480 | gi\|Fabrus\|VH3-23__IGHD2-2*01 > 2__IGHJ2*01 | 2337 |
| 481 | gi\|Fabrus\|VH3-23__IGHD2-2*01 > 3__IGHJ2*01 | 2338 |
| 482 | gi\|Fabrus\|VH3-23__IGHD2-8*01 > 2__IGHJ2*01 | 2339 |
| 483 | gi\|Fabrus\|VH3-23__IGHD2-8*01 > 3__IGHJ2*01 | 2340 |
| 484 | gi\|Fabrus\|VH3-23__IGHD2-15*01 > 2__IGHJ2*01 | 2341 |
| 485 | gi\|Fabrus\|VH3-23__IGHD2-15*01 > 3__IGHJ2*01 | 2342 |
| 486 | gi\|Fabrus\|VH3-23__IGHD2-21*01 > 2__IGHJ2*01 | 2343 |
| 487 | gi\|Fabrus\|VH3-23__IGHD2-21*01 > 3__IGHJ2*01 | 2344 |
| 488 | gi\|Fabrus\|VH3-23__IGHD3-3*01 > 1__IGHJ2*01 | 2345 |
| 489 | gi\|Fabrus\|VH3-23__IGHD3-3*01 > 2__IGHJ2*01 | 2346 |
| 490 | gi\|Fabrus\|VH3-23__IGHD3-3*01 > 3__IGHJ2*01 | 2347 |
| 491 | gi\|Fabrus\|VH3-23__IGHD3-9*01 > 2__IGHJ2*01 | 2348 |
| 492 | gi\|Fabrus\|VH3-23__IGHD3-10*01 > 2__IGHJ2*01 | 2349 |
| 493 | gi\|Fabrus\|VH3-23__IGHD3-10*01 > 3__IGHJ2*01 | 2350 |
| 494 | gi\|Fabrus\|VH3-23__IGHD3-16*01 > 2__IGHJ2*01 | 2351 |
| 495 | gi\|Fabrus\|VH3-23__IGHD3-16*01 > 3__IGHJ2*01 | 2352 |
| 496 | gi\|Fabrus\|VH3-23__IGHD3-22*01 > 2__IGHJ2*01 | 2353 |
| 497 | gi\|Fabrus\|VH3-23__IGHD3-22*01 > 3__IGHJ2*01 | 2354 |
| 498 | gi\|Fabrus\|VH3-23__IGHD4-4*01(1) > 2__IGHJ2*01 | 2355 |
| 499 | gi\|Fabrus\|VH3-23__IGHD4-4*01(1) > 3__IGHJ2*01 | 2356 |
| 500 | gi\|Fabrus\|VH3-23__IGHD4-11*01(1) > 2__IGHJ2*01 | 2357 |
| 501 | gi\|Fabrus\|VH3-23__IGHD4-11*01(1) > 3__IGHJ2*01 | 2358 |
| 502 | gi\|Fabrus\|VH3-23__IGHD4-17*01 > 2__IGHJ2*01 | 2359 |
| 503 | gi\|Fabrus\|VH3-23__IGHD4-17*01 > 3__IGHJ2*01 | 2360 |
| 504 | gi\|Fabrus\|VH3-23__IGHD4-23*01 > 2__IGHJ2*01 | 2361 |
| 505 | gi\|Fabrus\|VH3-23__IGHD4-23*01 > 3__IGHJ2*01 | 2362 |
| 506 | gi\|Fabrus\|VH3-23__IGHD5-5*01(2) > 1__IGHJ2*01 | 2363 |
| 507 | gi\|Fabrus\|VH3-23__IGHD5-5*01(2) > 2__IGHJ2*01 | 2364 |
| 508 | gi\|Fabrus\|VH3-23__IGHD5-5*01(2) > 3__IGHJ2*01 | 2365 |
| 509 | gi\|Fabrus\|VH3-23__IGHD5-12*01 > 1__IGHJ2*01 | 2366 |
| 510 | gi\|Fabrus\|VH3-23__IGHD5-12*01 > 3__IGHJ2*01 | 2367 |
| 511 | gi\|Fabrus\|VH3-23__IGHD5-18*01(2) > 1__IGHJ2*01 | 2368 |
| 512 | gi\|Fabrus\|VH3-23__IGHD5-18*01(2) > 2__IGHJ2*01 | 2369 |
| 513 | gi\|Fabrus\|VH3-23__IGHD5-18*01(2) > 3__IGHJ2*01 | 2370 |
| 514 | gi\|Fabrus\|VH3-23__IGHD5-24*01 > 1__IGHJ2*01 | 2371 |
| 515 | gi\|Fabrus\|VH3-23__IGHD5-24*01 > 3__IGHJ2*01 | 2372 |
| 516 | gi\|Fabrus\|VH3-23__IGHD6-6*01 > 1__IGHJ2*01 | 2373 |
| 517 | gi\|Fabrus\|VH3-23__IGHD6-6*01 > 2__IGHJ2*01 | 2374 |
| 518 | gi\|Fabrus\|VH3-23__IGHD6-13*01 > 1__IGHJ2*01 | 2375 |
| 519 | gi\|Fabrus\|VH3-23__IGHD6-13*01 > 2__IGHJ2*01 | 2376 |
| 520 | gi\|Fabrus\|VH3-23__IGHD6-19*01 > 1__IGHJ2*01 | 2377 |
| 521 | gi\|Fabrus\|VH3-23__IGHD6-19*01 > 2__IGHJ2*01 | 2378 |
| 522 | gi\|Fabrus\|VH3-23__IGHD6-25*01 > 1__IGHJ2*01 | 2379 |
| 523 | gi\|Fabrus\|VH3-23__IGHD6-25*01 > 2__IGHJ2*01 | 2380 |
| 524 | gi\|Fabrus\|VH3-23__IGHD7-27*01 > 1__IGHJ2*01 | 2381 |
| 525 | gi\|Fabrus\|VH3-23__IGHD7-27*01 > 3__IGHJ2*01 | 2382 |
| 526 | gi\|Fabrus\|VH3-23__IGHD1-1*01 > 1'__IGHJ1*01 | 2383 |
| 527 | gi\|Fabrus\|VH3-23__IGHD1-1*01 > 2'__IGHJ2*01 | 2384 |
| 528 | gi\|Fabrus\|VH3-23__IGHD1-1*01 > 3'__IGHJ2*01 | 2385 |
| 529 | gi\|Fabrus\|VH3-23__IGHD1-7*01 > 1'__IGHJ2*01 | 2386 |
| 530 | gi\|Fabrus\|VH3-23__IGHD1-7*01 > 3'__IGHJ2*01 | 2387 |
| 531 | gi\|Fabrus\|VH3-23__IGHD1-14*01 > 1'__IGHJ2*01 | 2388 |
| 532 | gi\|Fabrus\|VH3-23__IGHD1-14*01 > 2'__IGHJ2*01 | 2389 |
| 533 | gi\|Fabrus\|VH3-23__IGHD1-14*01 > 3'__IGHJ2*01 | 2390 |
| 534 | gi\|Fabrus\|VH3-23__IGHD1-20*01 > 1'__IGHJ2*01 | 2391 |
| 535 | gi\|Fabrus\|VH3-23__IGHD1-20*01 > 2'__IGHJ2*01 | 2392 |
| 536 | gi\|Fabrus\|VH3-23__IGHD1-20*01 > 3'__IGHJ2*01 | 2393 |
| 537 | gi\|Fabrus\|VH3-23__IGHD1-26*01 > 1'__IGHJ2*01 | 2394 |
| 538 | gi\|Fabrus\|VH3-23__IGHD1-26*01 > 3'__IGHJ2*01 | 2395 |
| 539 | gi\|Fabrus\|VH3-23__IGHD2-2*01 > 1'__IGHJ2*01 | 2396 |
| 540 | gi\|Fabrus\|VH3-23__IGHD2-2*01 > 3'__IGHJ2*01 | 2397 |
| 541 | gi\|Fabrus\|VH3-23__IGHD2-8*01 > 1'__IGHJ2*01 | 2398 |
| 542 | gi\|Fabrus\|VH3-23__IGHD2-15*01 > 1'__IGHJ2*01 | 2399 |
| 543 | gi\|Fabrus\|VH3-23__IGHD2-15*01 > 3'__IGHJ2*01 | 2400 |
| 544 | gi\|Fabrus\|VH3-23__IGHD2-21*01 > 1'__IGHJ2*01 | 2401 |
| 545 | gi\|Fabrus\|VH3-23__IGHD2-21*01 > 3'__IGHJ2*01 | 2402 |
| 546 | gi\|Fabrus\|VH3-23__IGHD3-3*01 > 1'__IGHJ2*01 | 2403 |
| 547 | gi\|Fabrus\|VH3-23__IGHD3-3*01 > 3'__IGHJ2*01 | 2404 |
| 548 | gi\|Fabrus\|VH3-23__IGHD3-9*01 > 1'__IGHJ2*01 | 2405 |
| 549 | gi\|Fabrus\|VH3-23__IGHD3-9*01 > 3'__IGHJ2*01 | 2406 |
| 550 | gi\|Fabrus\|VH3-23__IGHD3-10*01 > 1'__IGHJ2*01 | 2407 |
| 551 | gi\|Fabrus\|VH3-23__IGHD3-10*01 > 3'__IGHJ2*01 | 2408 |
| 552 | gi\|Fabrus\|VH3-23__IGHD3-16*01 > 1'__IGHJ2*01 | 2409 |
| 553 | gi\|Fabrus\|VH3-23__IGHD3-16*01 > 3'__IGHJ2*01 | 2410 |
| 554 | gi\|Fabrus\|VH3-23__IGHD3-22*01 > 1'__IGHJ2*01 | 2411 |
| 555 | gi\|Fabrus\|VH3-23__IGHD4-4*01(1) > 1'__IGHJ2*01 | 2412 |
| 556 | gi\|Fabrus\|VH3-23__IGHD4-4*01(1) > 3'__IGHJ2*01 | 2413 |
| 557 | gi\|Fabrus\|VH3-23__IGHD4-11*01(1) > 1'__IGHJ2*01 | 2414 |
| 558 | gi\|Fabrus\|VH3-23__IGHD4-11*01(1) > 3'__IGHJ2*01 | 2415 |
| 559 | gi\|Fabrus\|VH3-23__IGHD4-17*01 > 1'__IGHJ2*01 | 2416 |
| 560 | gi\|Fabrus\|VH3-23__IGHD4-17*01 > 3'__IGHJ2*01 | 2417 |
| 561 | gi\|Fabrus\|VH3-23__IGHD4-23*01 > 1'__IGHJ2*01 | 2418 |
| 562 | gi\|Fabrus\|VH3-23__IGHD4-23*01 > 3'__IGHJ2*01 | 2419 |
| 563 | gi\|Fabrus\|VH3-23__IGHD5-5*01(2) > 1'__IGHJ2*01 | 2420 |
| 564 | gi\|Fabrus\|VH3-23__IGHD5-5*01(2) > 3'__IGHJ2*01 | 2421 |
| 565 | gi\|Fabrus\|VH3-23__IGHD5-12*01 > 1'__IGHJ2*01 | 2422 |
| 566 | gi\|Fabrus\|VH3-23__IGHD5-12*01 > 3'__IGHJ2*01 | 2423 |

TABLE 3-continued

Exemplary Variable Heavy Chains and Light Chains

| Number | Name | SEQ ID NO. |
|---|---|---|
| 567 | gi\|Fabrus\|VH3-23__IGHD5-18*01(2) > 1'__IGHJ2*01 | 2424 |
| 568 | gi\|Fabrus\|VH3-23__IGHD5-18*01(2) > 3'__IGHJ2*01 | 2425 |
| 569 | gi\|Fabrus\|VH3-23__IGHD5-24*01 > 1'__IGHJ2*01 | 2426 |
| 570 | gi\|Fabrus\|VH3-23__IGHD5-24*01 > 3'__IGHJ2*01 | 2427 |
| 571 | gi\|Fabrus\|VH3-23__IGHD6-6*01 > 1'__IGHJ2*01 | 2428 |
| 572 | gi\|Fabrus\|VH3-23__IGHD6-6*01 > 2'__IGHJ2*01 | 2429 |
| 573 | gi\|Fabrus\|VH3-23__IGHD6-6*01 > 3'__IGHJ2*01 | 2430 |
| 574 | gi\|Fabrus\|VH3-23__IGHD6-13*01 > 1'__IGHJ2*01 | 2431 |
| 575 | gi\|Fabrus\|VH3-23__IGHD6-13*01 > 2'__IGHJ2*01 | 2432 |
| 576 | gi\|Fabrus\|VH3-23__IGHD6-13*01 > 3'__IGHJ2*01 | 2433 |
| 577 | gi\|Fabrus\|VH3-23__IGHD6-19*01 > 1'__IGHJ2*01 | 2434 |
| 578 | gi\|Fabrus\|VH3-23__IGHD6-19*01 > 2'__IGHJ2*01 | 2435 |
| 579 | gi\|Fabrus\|VH3-23__IGHD6-19*01 > 3'__IGHJ2*01 | 2436 |
| 580 | gi\|Fabrus\|VH3-23__IGHD6-25*01 > 1'__IGHJ2*01 | 2437 |
| 581 | gi\|Fabrus\|VH3-23__IGHD6-25*01 > 3'__IGHJ2*01 | 2438 |
| 582 | gi\|Fabrus\|VH3-23__IGHD7-27*01 > 1'__IGHJ2*01 | 2439 |
| 583 | gi\|Fabrus\|VH3-23__IGHD7-27*01 > 2'__IGHJ2*01 | 2440 |
| 584 | gi\|Fabrus\|VH3-23__IGHD1-1*01 > 1__IGHJ3*01 | 2441 |
| 585 | gi\|Fabrus\|VH3-23__IGHD1-1*01 > 2__IGHJ3*01 | 2442 |
| 586 | gi\|Fabrus\|VH3-23__IGHD1-1*01 > 3__IGHJ3*01 | 2443 |
| 587 | gi\|Fabrus\|VH3-23__IGHD1-7*01 > 1__IGHJ3*01 | 2444 |
| 588 | gi\|Fabrus\|VH3-23__IGHD1-7*01 > 3__IGHJ3*01 | 2445 |
| 589 | gi\|Fabrus\|VH3-23__IGHD1-14*01 > 1__IGHJ3*01 | 2446 |
| 590 | gi\|Fabrus\|VH3-23__IGHD1-14*01 > 3__IGHJ3*01 | 2447 |
| 591 | gi\|Fabrus\|VH3-23__IGHD1-20*01 > 1__IGHJ3*01 | 2448 |
| 592 | gi\|Fabrus\|VH3-23__IGHD1-20*01 > 3__IGHJ3*01 | 2449 |
| 593 | gi\|Fabrus\|VH3-23__IGHD1-26*01 > 1__IGHJ3*01 | 2450 |
| 594 | gi\|Fabrus\|VH3-23__IGHD1-26*01 > 3__IGHJ3*01 | 2451 |
| 595 | gi\|Fabrus\|VH3-23__IGHD2-2*01 > 2__IGHJ3*01 | 2452 |
| 596 | gi\|Fabrus\|VH3-23__IGHD2-2*01 > 3__IGHJ3*01 | 2453 |
| 597 | gi\|Fabrus\|VH3-23__IGHD2-8*01 > 2__IGHJ3*01 | 2454 |
| 598 | gi\|Fabrus\|VH3-23__IGHD2-8*01 > 3__IGHJ3*01 | 2455 |
| 599 | gi\|Fabrus\|VH3-23__IGHD2-15*01 > 2__IGHJ3*01 | 2456 |
| 600 | gi\|Fabrus\|VH3-23__IGHD2-15*01 > 3__IGHJ3*01 | 2457 |
| 601 | gi\|Fabrus\|VH3-23__IGHD2-21*01 > 2__IGHJ3*01 | 2458 |
| 602 | gi\|Fabrus\|VH3-23__IGHD2-21*01 > 3__IGHJ3*01 | 2459 |
| 603 | gi\|Fabrus\|VH3-23__IGHD3-3*01 > 1__IGHJ3*01 | 2460 |
| 604 | gi\|Fabrus\|VH3-23__IGHD3-3*01 > 2__IGHJ3*01 | 2461 |
| 605 | gi\|Fabrus\|VH3-23__IGHD3-3*01 > 3__IGHJ3*01 | 2462 |
| 606 | gi\|Fabrus\|VH3-23__IGHD3-9*01 > 2__IGHJ3*01 | 2463 |
| 607 | gi\|Fabrus\|VH3-23__IGHD3-10*01 > 2__IGHJ3*01 | 2464 |
| 608 | gi\|Fabrus\|VH3-23__IGHD3-10*01 > 3__IGHJ3*01 | 2465 |
| 609 | gi\|Fabrus\|VH3-23__IGHD3-16*01 > 2__IGHJ3*01 | 2466 |
| 610 | gi\|Fabrus\|VH3-23__IGHD3-16*01 > 3__IGHJ3*01 | 2467 |
| 611 | gi\|Fabrus\|VH3-23__IGHD3-22*01 > 2__IGHJ3*01 | 2468 |
| 612 | gi\|Fabrus\|VH3-23__IGHD3-22*01 > 3__IGHJ3*01 | 2469 |
| 613 | gi\|Fabrus\|VH3-23__IGHD4-4*01(1) > 2__IGHJ3*01 | 2470 |
| 614 | gi\|Fabrus\|VH3-23__IGHD4-4*01(1) > 3__IGHJ3*01 | 2471 |
| 615 | gi\|Fabrus\|VH3-23__IGHD4-11*01(1) > 2__IGHJ3*01 | 2472 |
| 616 | gi\|Fabrus\|VH3-23__IGHD4-11*01(1) > 3__IGHJ3*01 | 2473 |
| 617 | gi\|Fabrus\|VH3-23__IGHD4-17*01 > 2__IGHJ3*01 | 2474 |
| 618 | gi\|Fabrus\|VH3-23__IGHD4-17*01 > 3__IGHJ3*01 | 2475 |
| 619 | gi\|Fabrus\|VH3-23__IGHD4-23*01 > 2__IGHJ3*01 | 2476 |
| 620 | gi\|Fabrus\|VH3-23__IGHD4-23*01 > 3__IGHJ3*01 | 2477 |
| 621 | gi\|Fabrus\|VH3-23__IGHD5-5*01(2) > 1__IGHJ3*01 | 2478 |
| 622 | gi\|Fabrus\|VH3-23__IGHD5-5*01(2) > 2__IGHJ3*01 | 2479 |
| 623 | gi\|Fabrus\|VH3-23__IGHD5-5*01(2) > 3__IGHJ3*01 | 2480 |
| 624 | gi\|Fabrus\|VH3-23__IGHD5-12*01 > 1__IGHJ3*01 | 2481 |
| 625 | gi\|Fabrus\|VH3-23__IGHD5-12*01 > 3__IGHJ3*01 | 2482 |
| 626 | gi\|Fabrus\|VH3-23__IGHD5-18*01(2) > 1__IGHJ3*01 | 2483 |
| 627 | gi\|Fabrus\|VH3-23__IGHD5-18*01(2) > 2__IGHJ3*01 | 2484 |
| 628 | gi\|Fabrus\|VH3-23__IGHD5-18*01(2) > 3__IGHJ3*01 | 2485 |
| 629 | gi\|Fabrus\|VH3-23__IGHD5-24*01 > 1__IGHJ3*01 | 2486 |
| 630 | gi\|Fabrus\|VH3-23__IGHD5-24*01 > 3__IGHJ3*01 | 2487 |
| 631 | gi\|Fabrus\|VH3-23__IGHD6-6*01 > 1__IGHJ3*01 | 2488 |
| 632 | gi\|Fabrus\|VH3-23__IGHD6-6*01 > 2__IGHJ3*01 | 2489 |
| 633 | gi\|Fabrus\|VH3-23__IGHD6-13*01 > 1__IGHJ3*01 | 2490 |
| 634 | gi\|Fabrus\|VH3-23__IGHD6-13*01 > 2__IGHJ3*01 | 2491 |
| 635 | gi\|Fabrus\|VH3-23__IGHD6-19*01 > 1__IGHJ3*01 | 2492 |
| 636 | gi\|Fabrus\|VH3-23__IGHD6-19*01 > 2__IGHJ3*01 | 2493 |
| 637 | gi\|Fabrus\|VH3-23__IGHD6-25*01 > 1__IGHJ3*01 | 2494 |
| 638 | gi\|Fabrus\|VH3-23__IGHD6-25*01 > 2__IGHJ3*01 | 2495 |
| 639 | gi\|Fabrus\|VH3-23__IGHD7-27*01 > 1__IGHJ3*01 | 2496 |
| 640 | gi\|Fabrus\|VH3-23__IGHD7-27*01 > 3__IGHJ3*01 | 2497 |
| 641 | gi\|Fabrus\|VH3-23__IGHD1-1*01 > 1'__IGHJ3*01 | 2498 |
| 642 | gi\|Fabrus\|VH3-23__IGHD1-1*01 > 2'__IGHJ3*01 | 2499 |
| 643 | gi\|Fabrus\|VH3-23__IGHD1-1*01 > 3'__IGHJ3*01 | 2500 |
| 644 | gi\|Fabrus\|VH3-23__IGHD1-7*01 > 1'__IGHJ3*01 | 2501 |
| 645 | gi\|Fabrus\|VH3-23__IGHD1-7*01 > 3'__IGHJ3*01 | 2502 |
| 646 | gi\|Fabrus\|VH3-23__IGHD1-14*01 > 1'__IGHJ3*01 | 2503 |
| 647 | gi\|Fabrus\|VH3-23__IGHD1-14*01 > 2'__IGHJ3*01 | 2504 |
| 648 | gi\|Fabrus\|VH3-23__IGHD1-14*01 > 3'__IGHJ3*01 | 2505 |
| 649 | gi\|Fabrus\|VH3-23__IGHD1-20*01 > 1'__IGHJ3*01 | 2506 |
| 650 | gi\|Fabrus\|VH3-23__IGHD1-20*01 > 2'__IGHJ3*01 | 2507 |
| 651 | gi\|Fabrus\|VH3-23__IGHD1-20*01 > 3'__IGHJ3*01 | 2508 |
| 652 | gi\|Fabrus\|VH3-23__IGHD1-26*01 > 1'__IGHJ3*01 | 2509 |
| 653 | gi\|Fabrus\|VH3-23__IGHD1-26*01 > 3'__IGHJ3*01 | 2510 |
| 654 | gi\|Fabrus\|VH3-23__IGHD2-2*01 > 1'__IGHJ3*01 | 2511 |
| 655 | gi\|Fabrus\|VH3-23__IGHD2-2*01 > 3'__IGHJ3*01 | 2512 |
| 656 | gi\|Fabrus\|VH3-23__IGHD2-8*01 > 1'__IGHJ3*01 | 2513 |
| 657 | gi\|Fabrus\|VH3-23__IGHD2-15*01 > 1'__IGHJ3*01 | 2514 |
| 658 | gi\|Fabrus\|VH3-23__IGHD2-15*01 > 3'__IGHJ3*01 | 2515 |
| 659 | gi\|Fabrus\|VH3-23__IGHD2-21*01 > 1'__IGHJ3*01 | 2516 |
| 660 | gi\|Fabrus\|VH3-23__IGHD2-21*01 > 3'__IGHJ3*01 | 2517 |
| 661 | gi\|Fabrus\|VH3-23__IGHD3-3*01 > 1'__IGHJ3*01 | 2518 |
| 662 | gi\|Fabrus\|VH3-23__IGHD3-3*01 > 3'__IGHJ3*01 | 2519 |
| 663 | gi\|Fabrus\|VH3-23__IGHD3-9*01 > 1'__IGHJ3*01 | 2520 |
| 664 | gi\|Fabrus\|VH3-23__IGHD3-9*01 > 3'__IGHJ3*01 | 2521 |
| 665 | gi\|Fabrus\|VH3-23__IGHD3-10*01 > 1'__IGHJ3*01 | 105 |
| 666 | gi\|Fabrus\|VH3-23__IGHD3-10*01 > 3'__IGHJ3*01 | 2522 |
| 667 | gi\|Fabrus\|VH3-23__IGHD3-16*01 > 1'__IGHJ3*01 | 2523 |
| 668 | gi\|Fabrus\|VH3-23__IGHD3-16*01 > 3'__IGHJ3*01 | 2524 |
| 669 | gi\|Fabrus\|VH3-23__IGHD3-22*01 > 1'__IGHJ3*01 | 2525 |
| 670 | gi\|Fabrus\|VH3-23__IGHD4-4*01(1) > 1'__IGHJ3*01 | 2526 |
| 671 | gi\|Fabrus\|VH3-23__IGHD4-4*01(1) > 3'__IGHJ3*01 | 2527 |
| 672 | gi\|Fabrus\|VH3-23__IGHD4-11*01(1) > 1'__IGHJ3*01 | 2528 |
| 673 | gi\|Fabrus\|VH3-23__IGHD4-11*01(1) > 3'__IGHJ3*01 | 2529 |
| 674 | gi\|Fabrus\|VH3-23__IGHD4-17*01 > 1'__IGHJ3*01 | 2530 |
| 675 | gi\|Fabrus\|VH3-23__IGHD4-17*01 > 3'__IGHJ3*01 | 2531 |
| 676 | gi\|Fabrus\|VH3-23__IGHD4-23*01 > 1'__IGHJ3*01 | 2532 |
| 677 | gi\|Fabrus\|VH3-23__IGHD4-23*01 > 3'__IGHJ3*01 | 2533 |
| 678 | gi\|Fabrus\|VH3-23__IGHD5-5*01(2) > 1'__IGHJ3*01 | 2534 |
| 679 | gi\|Fabrus\|VH3-23__IGHD5-5*01(2) > 3'__IGHJ3*01 | 2535 |
| 680 | gi\|Fabrus\|VH3-23__IGHD5-12*01 > 1'__IGHJ3*01 | 2536 |
| 681 | gi\|Fabrus\|VH3-23__IGHD5-12*01 > 3'__IGHJ3*01 | 2537 |
| 682 | gi\|Fabrus\|VH3-23__IGHD5-18*01(2) > 1'__IGHJ3*01 | 2538 |
| 683 | gi\|Fabrus\|VH3-23__IGHD5-18*01(2) > 3'__IGHJ3*01 | 2539 |
| 684 | gi\|Fabrus\|VH3-23__IGHD5-24*01 > 1'__IGHJ3*01 | 2540 |
| 685 | gi\|Fabrus\|VH3-23__IGHD5-24*01 > 3'__IGHJ3*01 | 2541 |
| 686 | gi\|Fabrus\|VH3-23__IGHD6-6*01 > 1'__IGHJ3*01 | 2542 |
| 687 | gi\|Fabrus\|VH3-23__IGHD6-6*01 > 2'__IGHJ3*01 | 2543 |
| 688 | gi\|Fabrus\|VH3-23__IGHD6-6*01 > 3'__IGHJ3*01 | 2544 |
| 689 | gi\|Fabrus\|VH3-23__IGHD6-13*01 > 1'__IGHJ3*01 | 2545 |
| 690 | gi\|Fabrus\|VH3-23__IGHD6-13*01 > 2'__IGHJ3*01 | 2546 |
| 691 | gi\|Fabrus\|VH3-23__IGHD6-13*01 > 3'__IGHJ3*01 | 2547 |
| 692 | gi\|Fabrus\|VH3-23__IGHD6-19*01 > 1'__IGHJ3*01 | 2548 |
| 693 | gi\|Fabrus\|VH3-23__IGHD6-19*01 > 2'__IGHJ3*01 | 2549 |
| 694 | gi\|Fabrus\|VH3-23__IGHD6-19*01 > 3'__IGHJ3*01 | 2550 |
| 695 | gi\|Fabrus\|VH3-23__IGHD6-25*01 > 1'__IGHJ3*01 | 2551 |
| 696 | gi\|Fabrus\|VH3-23__IGHD6-25*01 > 3'__IGHJ3*01 | 2552 |
| 697 | gi\|Fabrus\|VH3-23__IGHD7-27*01 > 1'__IGHJ3*01 | 2553 |
| 698 | gi\|Fabrus\|VH3-23__IGHD7-27*01 > 2'__IGHJ3*01 | 2554 |
| 699 | gi\|Fabrus\|VH3-23__IGHD1-1*01 > 1__IGHJ4*01 | 2555 |
| 700 | gi\|Fabrus\|VH3-23__IGHD1-1*01 > 2__IGHJ4*01 | 2556 |
| 701 | gi\|Fabrus\|VH3-23__IGHD1-1*01 > 3__IGHJ4*01 | 2557 |
| 702 | gi\|Fabrus\|VH3-23__IGHD1-7*01 > 1__IGHJ4*01 | 2558 |
| 703 | gi\|Fabrus\|VH3-23__IGHD1-7*01 > 3__IGHJ4*01 | 2559 |
| 704 | gi\|Fabrus\|VH3-23__IGHD1-14*01 > 1__IGHJ4*01 | 2560 |
| 705 | gi\|Fabrus\|VH3-23__IGHD1-14*01 > 3__IGHJ4*01 | 2561 |
| 706 | gi\|Fabrus\|VH3-23__IGHD1-20*01 > 1__IGHJ4*01 | 2562 |
| 707 | gi\|Fabrus\|VH3-23__IGHD1-20*01 > 3__IGHJ4*01 | 2563 |
| 708 | gi\|Fabrus\|VH3-23__IGHD1-26*01 > 1__IGHJ4*01 | 2564 |
| 709 | gi\|Fabrus\|VH3-23__IGHD1-26*01 > 3__IGHJ4*01 | 2565 |
| 710 | gi\|Fabrus\|VH3-23__IGHD2-2*01 > 2__IGHJ4*01 | 2566 |
| 711 | gi\|Fabrus\|VH3-23__IGHD2-2*01 > 3__IGHJ4*01 | 2567 |
| 712 | gi\|Fabrus\|VH3-23__IGHD2-8*01 > 2__IGHJ4*01 | 2568 |
| 713 | gi\|Fabrus\|VH3-23__IGHD2-8*01 > 3__IGHJ4*01 | 2569 |
| 714 | gi\|Fabrus\|VH3-23__IGHD2-15*01 > 2__IGHJ4*01 | 2570 |
| 715 | gi\|Fabrus\|VH3-23__IGHD2-15*01 > 3__IGHJ4*01 | 2571 |
| 716 | gi\|Fabrus\|VH3-23__IGHD2-21*01 > 2__IGHJ4*01 | 2572 |

TABLE 3-continued

Exemplary Variable Heavy Chains and Light Chains

| Number | Name | SEQ ID NO. |
|---|---|---|
| 717 | gi\|Fabrus\|VH3-23__IGHD2-21*01 > 3__IGHJ4*01 | 2573 |
| 718 | gi\|Fabrus\|VH3-23__IGHD3-3*01 > 1__IGHJ4*01 | 2574 |
| 719 | gi\|Fabrus\|VH3-23__IGHD3-3*01 > 2__IGHJ4*01 | 2575 |
| 720 | gi\|Fabrus\|VH3-23__IGHD3-3*01 > 3__IGHJ4*01 | 2576 |
| 721 | gi\|Fabrus\|VH3-23__IGHD3-9*01 > 2__IGHJ4*01 | 2577 |
| 722 | gi\|Fabrus\|VH3-23__IGHD3-10*01 > 2__IGHJ4*01 | 2578 |
| 723 | gi\|Fabrus\|VH3-23__IGHD3-10*01 > 3__IGHJ4*01 | 2579 |
| 724 | gi\|Fabrus\|VH3-23__IGHD3-16*01 > 2__IGHJ4*01 | 2580 |
| 725 | gi\|Fabrus\|VH3-23__IGHD3-16*01 > 3__IGHJ4*01 | 2581 |
| 726 | gi\|Fabrus\|VH3-23__IGHD3-22*01 > 2__IGHJ4*01 | 2582 |
| 727 | gi\|Fabrus\|VH3-23__IGHD3-22*01 > 3__IGHJ4*01 | 2583 |
| 728 | gi\|Fabrus\|VH3-23__IGHD4-4*01(1) > 2__IGHJ4*01 | 2584 |
| 729 | gi\|Fabrus\|VH3-23__IGHD4-4*01(1) > 3__IGHJ4*01 | 2585 |
| 730 | gi\|Fabrus\|VH3-23__IGHD4-11*01(1) > 2__IGHJ4*01 | 2586 |
| 731 | gi\|Fabrus\|VH3-23__IGHD4-11*01(1) > 3__IGHJ4*01 | 2587 |
| 732 | gi\|Fabrus\|VH3-23__IGHD4-17*01 > 2__IGHJ4*01 | 2588 |
| 733 | gi\|Fabrus\|VH3-23__IGHD4-17*01 > 3__IGHJ4*01 | 2589 |
| 734 | gi\|Fabrus\|VH3-23__IGHD4-23*01 > 2__IGHJ4*01 | 2590 |
| 735 | gi\|Fabrus\|VH3-23__IGHD4-23*01 > 3__IGHJ4*01 | 2591 |
| 736 | gi\|Fabrus\|VH3-23__IGHD5-5*01(2) > 1__IGHJ4*01 | 2592 |
| 737 | gi\|Fabrus\|VH3-23__IGHD5-5*01(2) > 2__IGHJ4*01 | 2593 |
| 738 | gi\|Fabrus\|VH3-23__IGHD5-5*01(2) > 3__IGHJ4*01 | 2594 |
| 739 | gi\|Fabrus\|VH3-23__IGHD5-12*01 > 1__IGHJ4*01 | 2595 |
| 740 | gi\|Fabrus\|VH3-23__IGHD5-12*01 > 3__IGHJ4*01 | 2596 |
| 741 | gi\|Fabrus\|VH3-23__IGHD5-18*01(2) > 1__IGHJ4*01 | 2597 |
| 742 | gi\|Fabrus\|VH3-23__IGHD5-18*01(2) > 2__IGHJ4*01 | 2598 |
| 743 | gi\|Fabrus\|VH3-23__IGHD5-18*01(2) > 3__IGHJ4*01 | 2599 |
| 744 | gi\|Fabrus\|VH3-23__IGHD5-24*01 > 1__IGHJ4*01 | 2600 |
| 745 | gi\|Fabrus\|VH3-23__IGHD5-24*01 > 3__IGHJ4*01 | 2601 |
| 746 | gi\|Fabrus\|VH3-23__IGHD6-6*01 > 1__IGHJ4*01 | 2602 |
| 747 | gi\|Fabrus\|VH3-23__IGHD6-6*01 > 2__IGHJ4*01 | 2603 |
| 748 | gi\|Fabrus\|VH3-23__IGHD6-13*01 > 1__IGHJ4*01 | 2604 |
| 749 | gi\|Fabrus\|VH3-23__IGHD6-13*01 > 2__IGHJ4*01 | 2605 |
| 750 | gi\|Fabrus\|VH3-23__IGHD6-19*01 > 1__IGHJ4*01 | 2606 |
| 751 | gi\|Fabrus\|VH3-23__IGHD6-19*01 > 2__IGHJ4*01 | 2607 |
| 752 | gi\|Fabrus\|VH3-23__IGHD6-25*01 > 1__IGHJ4*01 | 2608 |
| 753 | gi\|Fabrus\|VH3-23__IGHD6-25*01 > 2__IGHJ4*01 | 2609 |
| 754 | gi\|Fabrus\|VH3-23__IGHD7-27*01 > 1__IGHJ4*01 | 2610 |
| 755 | gi\|Fabrus\|VH3-23__IGHD7-27*01 > 3__IGHJ4*01 | 2611 |
| 756 | gi\|Fabrus\|VH3-23__IGHD1-1*01 > 1'__IGHJ4*01 | 2612 |
| 757 | gi\|Fabrus\|VH3-23__IGHD1-1*01 > 2'__IGHJ4*01 | 2613 |
| 758 | gi\|Fabrus\|VH3-23__IGHD1-1*01 > 3'__IGHJ4*01 | 2614 |
| 759 | gi\|Fabrus\|VH3-23__IGHD1-7*01 > 1'__IGHJ4*01 | 2615 |
| 760 | gi\|Fabrus\|VH3-23__IGHD1-7*01 > 3'__IGHJ4*01 | 2616 |
| 761 | gi\|Fabrus\|VH3-23__IGHD1-14*01 > 1'__IGHJ4*01 | 2617 |
| 762 | gi\|Fabrus\|VH3-23__IGHD1-14*01 > 2'__IGHJ4*01 | 2618 |
| 763 | gi\|Fabrus\|VH3-23__IGHD1-14*01 > 3'__IGHJ4*01 | 2619 |
| 764 | gi\|Fabrus\|VH3-23__IGHD1-20*01 > 1'__IGHJ4*01 | 2620 |
| 765 | gi\|Fabrus\|VH3-23__IGHD1-20*01 > 2'__IGHJ4*01 | 2621 |
| 766 | gi\|Fabrus\|VH3-23__IGHD1-20*01 > 3'__IGHJ4*01 | 2622 |
| 767 | gi\|Fabrus\|VH3-23__IGHD1-26*01 > 1'__IGHJ4*01 | 2623 |
| 768 | gi\|Fabrus\|VH3-23__IGHD1-26*01 > 3'__IGHJ4*01 | 2624 |
| 769 | gi\|Fabrus\|VH3-23__IGHD2-2*01 > 1'__IGHJ4*01 | 2625 |
| 770 | gi\|Fabrus\|VH3-23__IGHD2-2*01 > 3'__IGHJ4*01 | 2626 |
| 771 | gi\|Fabrus\|VH3-23__IGHD2-8*01 > 1'__IGHJ4*01 | 2627 |
| 772 | gi\|Fabrus\|VH3-23__IGHD2-15*01 > 1'__IGHJ4*01 | 2628 |
| 773 | gi\|Fabrus\|VH3-23__IGHD2-15*01 > 3'__IGHJ4*01 | 2629 |
| 774 | gi\|Fabrus\|VH3-23__IGHD2-21*01 > 1'__IGHJ4*01 | 2630 |
| 775 | gi\|Fabrus\|VH3-23__IGHD2-21*01 > 3'__IGHJ4*01 | 2631 |
| 776 | gi\|Fabrus\|VH3-23__IGHD3-3*01 > 1'__IGHJ4*01 | 2632 |
| 777 | gi\|Fabrus\|VH3-23__IGHD3-3*01 > 3'__IGHJ4*01 | 2633 |
| 778 | gi\|Fabrus\|VH3-23__IGHD3-9*01 > 1'__IGHJ4*01 | 2634 |
| 779 | gi\|Fabrus\|VH3-23__IGHD3-9*01 > 3'__IGHJ4*01 | 2635 |
| 780 | gi\|Fabrus\|VH3-23__IGHD3-10*01 > 1'__IGHJ4*01 | 2636 |
| 781 | gi\|Fabrus\|VH3-23__IGHD3-10*01 > 3'__IGHJ4*01 | 2637 |
| 782 | gi\|Fabrus\|VH3-23__IGHD3-16*01 > 1'__IGHJ4*01 | 2638 |
| 783 | gi\|Fabrus\|VH3-23__IGHD3-16*01 > 3'__IGHJ4*01 | 2639 |
| 784 | gi\|Fabrus\|VH3-23__IGHD3-22*01 > 1'__IGHJ4*01 | 2640 |
| 785 | gi\|Fabrus\|VH3-23__IGHD4-4*01(1) > 1'__IGHJ4*01 | 2641 |
| 786 | gi\|Fabrus\|VH3-23__IGHD4-4*01(1) > 3'__IGHJ4*01 | 2642 |
| 787 | gi\|Fabrus\|VH3-23__IGHD4-11*01(1) > 1'__IGHJ4*01 | 2643 |
| 788 | gi\|Fabrus\|VH3-23__IGHD4-11*01(1) > 3'__IGHJ4*01 | 2644 |
| 789 | gi\|Fabrus\|VH3-23__IGHD4-17*01 > 1'__IGHJ4*01 | 2645 |
| 790 | gi\|Fabrus\|VH3-23__IGHD4-17*01 > 3'__IGHJ4*01 | 2646 |
| 791 | gi\|Fabrus\|VH3-23__IGHD4-23*01 > 1'__IGHJ4*01 | 2647 |
| 792 | gi\|Fabrus\|VH3-23__IGHD4-23*01 > 3'__IGHJ4*01 | 2648 |
| 793 | gi\|Fabrus\|VH3-23__IGHD5-5*01(2) > 1'__IGHJ4*01 | 2649 |
| 794 | gi\|Fabrus\|VH3-23__IGHD5-5*01(2) > 3'__IGHJ4*01 | 2650 |
| 795 | gi\|Fabrus\|VH3-23__IGHD5-12*01 > 1'__IGHJ4*01 | 2651 |
| 796 | gi\|Fabrus\|VH3-23__IGHD5-12*01 > 3'__IGHJ4*01 | 2652 |
| 797 | gi\|Fabrus\|VH3-23__IGHD5-18*01(2) > 1'__IGHJ4*01 | 2653 |
| 798 | gi\|Fabrus\|VH3-23__IGHD5-18*01(2) > 3'__IGHJ4*01 | 2654 |
| 799 | gi\|Fabrus\|VH3-23__IGHD5-24*01 > 1'__IGHJ4*01 | 2655 |
| 800 | gi\|Fabrus\|VH3-23__IGHD5-24*01 > 3'__IGHJ4*01 | 2656 |
| 801 | gi\|Fabrus\|VH3-23__IGHD6-6*01 > 1'__IGHJ4*01 | 2657 |
| 802 | gi\|Fabrus\|VH3-23__IGHD6-6*01 > 2'__IGHJ4*01 | 2658 |
| 803 | gi\|Fabrus\|VH3-23__IGHD6-6*01 > 3'__IGHJ4*01 | 2659 |
| 804 | gi\|Fabrus\|VH3-23__IGHD6-13*01 > 1'__IGHJ4*01 | 2660 |
| 805 | gi\|Fabrus\|VH3-23__IGHD6-13*01 > 2'__IGHJ4*01 | 2661 |
| 806 | gi\|Fabrus\|VH3-23__IGHD6-13*01 > 3'__IGHJ4*01 | 2662 |
| 807 | gi\|Fabrus\|VH3-23__IGHD6-19*01 > 1'__IGHJ4*01 | 2663 |
| 808 | gi\|Fabrus\|VH3-23__IGHD6-19*01 > 2'__IGHJ4*01 | 2664 |
| 809 | gi\|Fabrus\|VH3-23__IGHD6-19*01 > 3'__IGHJ4*01 | 2665 |
| 810 | gi\|Fabrus\|VH3-23__IGHD6-25*01 > 1'__IGHJ4*01 | 2666 |
| 811 | gi\|Fabrus\|VH3-23__IGHD6-25*01 > 3'__IGHJ4*01 | 2667 |
| 812 | gi\|Fabrus\|VH3-23__IGHD7-27*01 > 1'__IGHJ4*01 | 2668 |
| 813 | gi\|Fabrus\|VH3-23__IGHD7-27*01 > 2'__IGHJ4*01 | 2669 |
| 814 | gi\|Fabrus\|VH3-23__IGHD1-1*01 > 1__IGHJ5*01 | 2670 |
| 815 | gi\|Fabrus\|VH3-23__IGHD1-1*01 > 2__IGHJ5*01 | 2671 |
| 816 | gi\|Fabrus\|VH3-23__IGHD1-1*01 > 3__IGHJ5*01 | 2672 |
| 817 | gi\|Fabrus\|VH3-23__IGHD1-7*01 > 1__IGHJ5*01 | 2673 |
| 818 | gi\|Fabrus\|VH3-23__IGHD1-7*01 > 3__IGHJ5*01 | 2674 |
| 819 | gi\|Fabrus\|VH3-23__IGHD1-14*01 > 1__IGHJ5*01 | 2675 |
| 820 | gi\|Fabrus\|VH3-23__IGHD1-14*01 > 3__IGHJ5*01 | 2676 |
| 821 | gi\|Fabrus\|VH3-23__IGHD1-20*01 > 1__IGHJ5*01 | 2677 |
| 822 | gi\|Fabrus\|VH3-23__IGHD1-20*01 > 3__IGHJ5*01 | 2678 |
| 823 | gi\|Fabrus\|VH3-23__IGHD1-26*01 > 1__IGHJ5*01 | 2679 |
| 824 | gi\|Fabrus\|VH3-23__IGHD1-26*01 > 3__IGHJ5*01 | 2680 |
| 825 | gi\|Fabrus\|VH3-23__IGHD2-2*01 > 2__IGHJ5*01 | 2681 |
| 826 | gi\|Fabrus\|VH3-23__IGHD2-2*01 > 3__IGHJ5*01 | 2682 |
| 827 | gi\|Fabrus\|VH3-23__IGHD2-8*01 > 2__IGHJ5*01 | 2683 |
| 828 | gi\|Fabrus\|VH3-23__IGHD2-8*01 > 3__IGHJ5*01 | 2684 |
| 829 | gi\|Fabrus\|VH3-23__IGHD2-15*01 > 2__IGHJ5*01 | 2685 |
| 830 | gi\|Fabrus\|VH3-23__IGHD2-15*01 > 3__IGHJ5*01 | 2686 |
| 831 | gi\|Fabrus\|VH3-23__IGHD2-21*01 > 2__IGHJ5*01 | 2687 |
| 832 | gi\|Fabrus\|VH3-23__IGHD2-21*01 > 3__IGHJ5*01 | 2688 |
| 833 | gi\|Fabrus\|VH3-23__IGHD3-3*01 > 1__IGHJ5*01 | 2689 |
| 834 | gi\|Fabrus\|VH3-23__IGHD3-3*01 > 2__IGHJ5*01 | 2690 |
| 835 | gi\|Fabrus\|VH3-23__IGHD3-3*01 > 3__IGHJ5*01 | 2691 |
| 836 | gi\|Fabrus\|VH3-23__IGHD3-9*01 > 2__IGHJ5*01 | 2692 |
| 837 | gi\|Fabrus\|VH3-23__IGHD3-10*01 > 2__IGHJ5*01 | 2693 |
| 838 | gi\|Fabrus\|VH3-23__IGHD3-10*01 > 3__IGHJ5*01 | 2694 |
| 839 | gi\|Fabrus\|VH3-23__IGHD3-16*01 > 2__IGHJ5*01 | 2695 |
| 840 | gi\|Fabrus\|VH3-23__IGHD3-16*01 > 3__IGHJ5*01 | 2696 |
| 841 | gi\|Fabrus\|VH3-23__IGHD3-22*01 > 2__IGHJ5*01 | 2697 |
| 842 | gi\|Fabrus\|VH3-23__IGHD3-22*01 > 3__IGHJ5*01 | 2698 |
| 843 | gi\|Fabrus\|VH3-23__IGHD4-4*01(1) > 2__IGHJ5*01 | 2699 |
| 844 | gi\|Fabrus\|VH3-23__IGHD4-4*01(1) > 3__IGHJ5*01 | 2700 |
| 845 | gi\|Fabrus\|VH3-23__IGHD4-11*01(1) > 2__IGHJ5*01 | 2701 |
| 846 | gi\|Fabrus\|VH3-23__IGHD4-11*01(1) > 3__IGHJ5*01 | 2702 |
| 847 | gi\|Fabrus\|VH3-23__IGHD4-17*01 > 2__IGHJ5*01 | 2703 |
| 848 | gi\|Fabrus\|VH3-23__IGHD4-17*01 > 3__IGHJ5*01 | 2704 |
| 849 | gi\|Fabrus\|VH3-23__IGHD4-23*01 > 2__IGHJ5*01 | 2705 |
| 850 | gi\|Fabrus\|VH3-23__IGHD4-23*01 > 3__IGHJ5*01 | 2706 |
| 851 | gi\|Fabrus\|VH3-23__IGHD5-5*01(2) > 1__IGHJ5*01 | 2707 |
| 852 | gi\|Fabrus\|VH3-23__IGHD5-5*01(2) > 2__IGHJ5*01 | 2708 |
| 853 | gi\|Fabrus\|VH3-23__IGHD5-5*01(2) > 3__IGHJ5*01 | 2709 |
| 854 | gi\|Fabrus\|VH3-23__IGHD5-12*01 > 1__IGHJ5*01 | 2710 |
| 855 | gi\|Fabrus\|VH3-23__IGHD5-12*01 > 3__IGHJ5*01 | 2711 |
| 856 | gi\|Fabrus\|VH3-23__IGHD5-18*01(2) > 1__IGHJ5*01 | 2712 |
| 857 | gi\|Fabrus\|VH3-23__IGHD5-18*01(2) > 2__IGHJ5*01 | 2713 |
| 858 | gi\|Fabrus\|VH3-23__IGHD5-18*01(2) > 3__IGHJ5*01 | 2714 |
| 859 | gi\|Fabrus\|VH3-23__IGHD5-24*01 > 1__IGHJ5*01 | 2715 |
| 860 | gi\|Fabrus\|VH3-23__IGHD5-24*01 > 3__IGHJ5*01 | 2716 |
| 861 | gi\|Fabrus\|VH3-23__IGHD6-6*01 > 1__IGHJ5*01 | 2717 |
| 862 | gi\|Fabrus\|VH3-23__IGHD6-6*01 > 2__IGHJ5*01 | 2718 |
| 863 | gi\|Fabrus\|VH3-23__IGHD6-13*01 > 1__IGHJ5*01 | 2719 |
| 864 | gi\|Fabrus\|VH3-23__IGHD6-13*01 > 2__IGHJ5*01 | 2720 |
| 865 | gi\|Fabrus\|VH3-23__IGHD6-19*01 > 1__IGHJ5*01 | 2721 |
| 866 | gi\|Fabrus\|VH3-23__IGHD6-19*01 > 2__IGHJ5*01 | 2722 |

TABLE 3-continued

Exemplary Variable Heavy Chains and Light Chains

| Number | Name | SEQ ID NO. |
|---|---|---|
| 867 | gi\|Fabrus\|VH3-23__IGHD6-25*01 > 1__IGHJ5*01 | 2723 |
| 868 | gi\|Fabrus\|VH3-23__IGHD6-25*01 > 2__IGHJ5*01 | 2724 |
| 869 | gi\|Fabrus\|VH3-23__IGHD7-27*01 > 1__IGHJ5*01 | 2725 |
| 870 | gi\|Fabrus\|VH3-23__IGHD7-27*01 > 3__IGHJ5*01 | 2726 |
| 871 | gi\|Fabrus\|VH3-23__IGHD1-1*01 > 1'__IGHJ5*01 | 2727 |
| 872 | gi\|Fabrus\|VH3-23__IGHD1-1*01 > 2'__IGHJ5*01 | 2728 |
| 873 | gi\|Fabrus\|VH3-23__IGHD1-1*01 > 3'__IGHJ5*01 | 2729 |
| 874 | gi\|Fabrus\|VH3-23__IGHD1-7*01 > 1'__IGHJ5*01 | 2730 |
| 875 | gi\|Fabrus\|VH3-23__IGHD1-7*01 > 3'__IGHJ5*01 | 2731 |
| 876 | gi\|Fabrus\|VH3-23__IGHD1-14*01 > 1'__IGHJ5*01 | 2732 |
| 877 | gi\|Fabrus\|VH3-23__IGHD1-14*01 > 2'__IGHJ5*01 | 2733 |
| 878 | gi\|Fabrus\|VH3-23__IGHD1-14*01 > 3'__IGHJ5*01 | 2734 |
| 879 | gi\|Fabrus\|VH3-23__IGHD1-20*01 > 1'__IGHJ5*01 | 2735 |
| 880 | gi\|Fabrus\|VH3-23__IGHD1-20*01 > 2'__IGHJ5*01 | 2736 |
| 881 | gi\|Fabrus\|VH3-23__IGHD1-20*01 > 3'__IGHJ5*01 | 2737 |
| 882 | gi\|Fabrus\|VH3-23__IGHD1-26*01 > 1'__IGHJ5*01 | 2738 |
| 883 | gi\|Fabrus\|VH3-23__IGHD1-26*01 > 3'__IGHJ5*01 | 2739 |
| 884 | gi\|Fabrus\|VH3-23__IGHD2-2*01 > 1'__IGHJ5*01 | 2740 |
| 885 | gi\|Fabrus\|VH3-23__IGHD2-2*01 > 3'__IGHJ5*01 | 2741 |
| 886 | gi\|Fabrus\|VH3-23__IGHD2-8*01 > 1'__IGHJ5*01 | 2742 |
| 887 | gi\|Fabrus\|VH3-23__IGHD2-15*01 > 1'__IGHJ5*01 | 2743 |
| 888 | gi\|Fabrus\|VH3-23__IGHD2-15*01 > 3'__IGHJ5*01 | 2744 |
| 889 | gi\|Fabrus\|VH3-23__IGHD2-21*01 > 1'__IGHJ5*01 | 2745 |
| 890 | gi\|Fabrus\|VH3-23__IGHD2-21*01 > 3'__IGHJ5*01 | 2746 |
| 891 | gi\|Fabrus\|VH3-23__IGHD3-3*01 > 1'__IGHJ5*01 | 2747 |
| 892 | gi\|Fabrus\|VH3-23__IGHD3-3*01 > 3'__IGHJ5*01 | 2748 |
| 893 | gi\|Fabrus\|VH3-23__IGHD3-9*01 > 1'__IGHJ5*01 | 2749 |
| 894 | gi\|Fabrus\|VH3-23__IGHD3-9*01 > 3'__IGHJ5*01 | 2750 |
| 895 | gi\|Fabrus\|VH3-23__IGHD3-10*01 > 1'__IGHJ5*01 | 2751 |
| 896 | gi\|Fabrus\|VH3-23__IGHD3-10*01 > 3'__IGHJ5*01 | 2752 |
| 897 | gi\|Fabrus\|VH3-23__IGHD3-16*01 > 1'__IGHJ5*01 | 2753 |
| 898 | gi\|Fabrus\|VH3-23__IGHD3-16*01 > 3'__IGHJ5*01 | 2754 |
| 899 | gi\|Fabrus\|VH3-23__IGHD3-22*01 > 1'__IGHJ5*01 | 2755 |
| 900 | gi\|Fabrus\|VH3-23__IGHD4-4*01(1) > 1'__IGHJ5*01 | 2756 |
| 901 | gi\|Fabrus\|VH3-23__IGHD4-4*01(1) > 3'__IGHJ5*01 | 2757 |
| 902 | gi\|Fabrus\|VH3-23__IGHD4-11*01(1) > 1'__IGHJ5*01 | 2758 |
| 903 | gi\|Fabrus\|VH3-23__IGHD4-11*01(1) > 3'__IGHJ5*01 | 2759 |
| 904 | gi\|Fabrus\|VH3-23__IGHD4-17*01 > 1'__IGHJ5*01 | 2760 |
| 905 | gi\|Fabrus\|VH3-23__IGHD4-17*01 > 3'__IGHJ5*01 | 2761 |
| 906 | gi\|Fabrus\|VH3-23__IGHD4-23*01 > 1'__IGHJ5*01 | 2762 |
| 907 | gi\|Fabrus\|VH3-23__IGHD4-23*01 > 3'__IGHJ5*01 | 2763 |
| 908 | gi\|Fabrus\|VH3-23__IGHD5-5*01(2) > 1'__IGHJ5*01 | 2764 |
| 909 | gi\|Fabrus\|VH3-23__IGHD5-5*01(2) > 3'__IGHJ5*01 | 2765 |
| 910 | gi\|Fabrus\|VH3-23__IGHD5-12*01 > 1'__IGHJ5*01 | 2766 |
| 911 | gi\|Fabrus\|VH3-23__IGHD5-12*01 > 3'__IGHJ5*01 | 2767 |
| 912 | gi\|Fabrus\|VH3-23__IGHD5-18*01(2) > 1'__IGHJ5*01 | 2768 |
| 913 | gi\|Fabrus\|VH3-23__IGHD5-18*01(2) > 3'__IGHJ5*01 | 2769 |
| 914 | gi\|Fabrus\|VH3-23__IGHD5-24*01 > 1'__IGHJ5*01 | 2770 |
| 915 | gi\|Fabrus\|VH3-23__IGHD5-24*01 > 3'__IGHJ5*01 | 2771 |
| 916 | gi\|Fabrus\|VH3-23__IGHD6-6*01 > 1'__IGHJ5*01 | 2772 |
| 917 | gi\|Fabrus\|VH3-23__IGHD6-6*01 > 2'__IGHJ5*01 | 2773 |
| 918 | gi\|Fabrus\|VH3-23__IGHD6-6*01 > 3'__IGHJ5*01 | 2774 |
| 919 | gi\|Fabrus\|VH3-23__IGHD6-13*01 > 1'__IGHJ5*01 | 2775 |
| 920 | gi\|Fabrus\|VH3-23__IGHD6-13*01 > 2'__IGHJ5*01 | 2776 |
| 921 | gi\|Fabrus\|VH3-23__IGHD6-13*01 > 3'__IGHJ5*01 | 2777 |
| 922 | gi\|Fabrus\|VH3-23__IGHD6-19*01 > 1'__IGHJ5*01 | 2778 |
| 923 | gi\|Fabrus\|VH3-23__IGHD6-19*01 > 2'__IGHJ5*01 | 2779 |
| 924 | gi\|Fabrus\|VH3-23__IGHD6-19*01 > 3'__IGHJ5*01 | 2780 |
| 925 | gi\|Fabrus\|VH3-23__IGHD6-25*01 > 1'__IGHJ5*01 | 2781 |
| 926 | gi\|Fabrus\|VH3-23__IGHD6-25*01 > 3'__IGHJ5*01 | 2782 |
| 927 | gi\|Fabrus\|VH3-23__IGHD7-27*01 > 1'__IGHJ5*01 | 2783 |
| 928 | gi\|Fabrus\|VH3-23__IGHD7-27*01 > 2'__IGHJ5*01 | 2784 |
| 929 | gi\|Fabrus\|VH3-23__IGHD1-1*01 > 1__IGHJ6*01 | 2785 |
| 930 | gi\|Fabrus\|VH3-23__IGHD1-1*01 > 2__IGHJ6*01 | 2786 |
| 931 | gi\|Fabrus\|VH3-23__IGHD1-1*01 > 3__IGHJ6*01 | 2787 |
| 932 | gi\|Fabrus\|VH3-23__IGHD1-7*01 > 1__IGHJ6*01 | 2788 |
| 933 | gi\|Fabrus\|VH3-23__IGHD1-7*01 > 3__IGHJ6*01 | 2789 |
| 934 | gi\|Fabrus\|VH3-23__IGHD1-14*01 > 1__IGHJ6*01 | 2790 |
| 935 | gi\|Fabrus\|VH3-23__IGHD1-14*01 > 3__IGHJ6*01 | 2791 |
| 936 | gi\|Fabrus\|VH3-23__IGHD1-20*01 > 1__IGHJ6*01 | 2792 |
| 937 | gi\|Fabrus\|VH3-23__IGHD1-20*01 > 3__IGHJ6*01 | 2793 |
| 938 | gi\|Fabrus\|VH3-23__IGHD1-26*01 > 1__IGHJ6*01 | 2794 |
| 939 | gi\|Fabrus\|VH3-23__IGHD1-26*01 > 3__IGHJ6*01 | 2795 |
| 940 | gi\|Fabrus\|VH3-23__IGHD2-2*01 > 2__IGHJ6*01 | 2796 |
| 941 | gi\|Fabrus\|VH3-23__IGHD2-2*01 > 3__IGHJ6*01 | 2797 |
| 942 | gi\|Fabrus\|VH3-23__IGHD2-8*01 > 2__IGHJ6*01 | 2798 |
| 943 | gi\|Fabrus\|VH3-23__IGHD2-8*01 > 3__IGHJ6*01 | 2799 |
| 944 | gi\|Fabrus\|VH3-23__IGHD2-15*01 > 2__IGHJ6*01 | 2800 |
| 945 | gi\|Fabrus\|VH3-23__IGHD2-15*01 > 3__IGHJ6*01 | 2801 |
| 946 | gi\|Fabrus\|VH3-23__IGHD2-21*01 > 2__IGHJ6*01 | 2802 |
| 947 | gi\|Fabrus\|VH3-23__IGHD2-21*01 > 3__IGHJ6*01 | 2803 |
| 948 | gi\|Fabrus\|VH3-23__IGHD3-3*01 > 1__IGHJ6*01 | 2804 |
| 949 | gi\|Fabrus\|VH3-23__IGHD3-3*01 > 2__IGHJ6*01 | 2805 |
| 950 | gi\|Fabrus\|VH3-23__IGHD3-3*01 > 3__IGHJ6*01 | 2806 |
| 951 | gi\|Fabrus\|VH3-23__IGHD3-9*01 > 2__IGHJ6*01 | 2807 |
| 952 | gi\|Fabrus\|VH3-23__IGHD3-10*01 > 2__IGHJ6*01 | 2808 |
| 953 | gi\|Fabrus\|VH3-23__IGHD3-10*01 > 3__IGHJ6*01 | 104 |
| 954 | gi\|Fabrus\|VH3-23__IGHD3-16*01 > 2__IGHJ6*01 | 2809 |
| 955 | gi\|Fabrus\|VH3-23__IGHD3-16*01 > 3__IGHJ6*01 | 2810 |
| 956 | gi\|Fabrus\|VH3-23__IGHD3-22*01 > 2__IGHJ6*01 | 2811 |
| 957 | gi\|Fabrus\|VH3-23__IGHD3-22*01 > 3__IGHJ6*01 | 2812 |
| 958 | gi\|Fabrus\|VH3-23__IGHD4-4*01(1) > 2__IGHJ6*01 | 2813 |
| 959 | gi\|Fabrus\|VH3-23__IGHD4-4*01(1) > 3__IGHJ6*01 | 2814 |
| 960 | gi\|Fabrus\|VH3-23__IGHD4-11*01(1) > 2__IGHJ6*01 | 2815 |
| 961 | gi\|Fabrus\|VH3-23__IGHD4-11*01(1) > 3__IGHJ6*01 | 2816 |
| 962 | gi\|Fabrus\|VH3-23__IGHD4-17*01 > 2__IGHJ6*01 | 2817 |
| 963 | gi\|Fabrus\|VH3-23__IGHD4-17*01 > 3__IGHJ6*01 | 2818 |
| 964 | gi\|Fabrus\|VH3-23__IGHD4-23*01 > 2__IGHJ6*01 | 2819 |
| 965 | gi\|Fabrus\|VH3-23__IGHD4-23*01 > 3__IGHJ6*01 | 2820 |
| 966 | gi\|Fabrus\|VH3-23__IGHD5-5*01(2) > 1__IGHJ6*01 | 2821 |
| 967 | gi\|Fabrus\|VH3-23__IGHD5-5*01(2) > 2__IGHJ6*01 | 2822 |
| 968 | gi\|Fabrus\|VH3-23__IGHD5-5*01(2) > 3__IGHJ6*01 | 2823 |
| 969 | gi\|Fabrus\|VH3-23__IGHD5-12*01 > 1__IGHJ6*01 | 2824 |
| 970 | gi\|Fabrus\|VH3-23__IGHD5-12*01 > 3__IGHJ6*01 | 2825 |
| 971 | gi\|Fabrus\|VH3-23__IGHD5-18*01(2) > 1__IGHJ6*01 | 2826 |
| 972 | gi\|Fabrus\|VH3-23__IGHD5-18*01(2) > 2__IGHJ6*01 | 2827 |
| 973 | gi\|Fabrus\|VH3-23__IGHD5-18*01(2) > 3__IGHJ6*01 | 2828 |
| 974 | gi\|Fabrus\|VH3-23__IGHD5-24*01 > 1__IGHJ6*01 | 2829 |
| 975 | gi\|Fabrus\|VH3-23__IGHD5-24*01 > 3__IGHJ6*01 | 2830 |
| 976 | gi\|Fabrus\|VH3-23__IGHD6-6*01 > 1__IGHJ6*01 | 2831 |
| 977 | gi\|Fabrus\|VH3-23__IGHD6-6*01 > 2__IGHJ6*01 | 2832 |
| 978 | gi\|Fabrus\|VH3-23__IGHD6-13*01 > 1__IGHJ6*01 | 2833 |
| 979 | gi\|Fabrus\|VH3-23__IGHD6-13*01 > 2__IGHJ6*01 | 2834 |
| 980 | gi\|Fabrus\|VH3-23__IGHD6-19*01 > 1__IGHJ6*01 | 2835 |
| 981 | gi\|Fabrus\|VH3-23__IGHD6-19*01 > 2__IGHJ6*01 | 2836 |
| 982 | gi\|Fabrus\|VH3-23__IGHD6-25*01 > 1__IGHJ6*01 | 2837 |
| 983 | gi\|Fabrus\|VH3-23__IGHD6-25*01 > 2__IGHJ6*01 | 2838 |
| 984 | gi\|Fabrus\|VH3-23__IGHD7-27*01 > 1__IGHJ6*01 | 2839 |
| 985 | gi\|Fabrus\|VH3-23__IGHD7-27*01 > 3__IGHJ6*01 | 2840 |
| 986 | gi\|Fabrus\|VH3-23__IGHD1-1*01 > 1'__IGHJ6*01 | 2841 |
| 987 | gi\|Fabrus\|VH3-23__IGHD1-1*01 > 2'__IGHJ6*01 | 2842 |
| 988 | gi\|Fabrus\|VH3-23__IGHD1-1*01 > 3'__IGHJ6*01 | 2843 |
| 989 | gi\|Fabrus\|VH3-23__IGHD1-7*01 > 1'__IGHJ6*01 | 2844 |
| 990 | gi\|Fabrus\|VH3-23__IGHD1-7*01 > 3'__IGHJ6*01 | 2845 |
| 991 | gi\|Fabrus\|VH3-23__IGHD1-14*01 > 1'__IGHJ6*01 | 2846 |
| 992 | gi\|Fabrus\|VH3-23__IGHD1-14*01 > 2'__IGHJ6*01 | 2847 |
| 993 | gi\|Fabrus\|VH3-23__IGHD1-14*01 > 3'__IGHJ6*01 | 2848 |
| 994 | gi\|Fabrus\|VH3-23__IGHD1-20*01 > 1'__IGHJ6*01 | 2849 |
| 995 | gi\|Fabrus\|VH3-23__IGHD1-20*01 > 2'__IGHJ6*01 | 2850 |
| 996 | gi\|Fabrus\|VH3-23__IGHD1-20*01 > 3'__IGHJ6*01 | 2851 |
| 997 | gi\|Fabrus\|VH3-23__IGHD1-26*01 > 1'__IGHJ6*01 | 2852 |
| 998 | gi\|Fabrus\|VH3-23__IGHD1-26*01 > 3'__IGHJ6*01 | 2853 |
| 999 | gi\|Fabrus\|VH3-23__IGHD2-2*01 > 1'__IGHJ6*01 | 2854 |
| 1000 | gi\|Fabrus\|VH3-23__IGHD2-2*01 > 3'__IGHJ6*01 | 2855 |
| 1001 | gi\|Fabrus\|VH3-23__IGHD2-8*01 > 1'__IGHJ6*01 | 2856 |
| 1002 | gi\|Fabrus\|VH3-23__IGHD2-15*01 > 1'__IGHJ6*01 | 2857 |
| 1003 | gi\|Fabrus\|VH3-23__IGHD2-15*01 > 3'__IGHJ6*01 | 2858 |
| 1004 | gi\|Fabrus\|VH3-23__IGHD2-21*01 > 1'__IGHJ6*01 | 2859 |
| 1005 | gi\|Fabrus\|VH3-23__IGHD2-21*01 > 3'__IGHJ6*01 | 2860 |
| 1006 | gi\|Fabrus\|VH3-23__IGHD3-3*01 > 1'__IGHJ6*01 | 2861 |
| 1007 | gi\|Fabrus\|VH3-23__IGHD3-3*01 > 3'__IGHJ6*01 | 2862 |
| 1008 | gi\|Fabrus\|VH3-23__IGHD3-9*01 > 1'__IGHJ6*01 | 2863 |
| 1009 | gi\|Fabrus\|VH3-23__IGHD3-9*01 > 3'__IGHJ6*01 | 2864 |
| 1010 | gi\|Fabrus\|VH3-23__IGHD3-10*01 > 1'__IGHJ6*01 | 2865 |
| 1011 | gi\|Fabrus\|VH3-23__IGHD3-10*01 > 3'__IGHJ6*01 | 2866 |
| 1012 | gi\|Fabrus\|VH3-23__IGHD3-16*01 > 1'__IGHJ6*01 | 2867 |
| 1013 | gi\|Fabrus\|VH3-23__IGHD3-16*01 > 3'__IGHJ6*01 | 2868 |
| 1014 | gi\|Fabrus\|VH3-23__IGHD3-22*01 > 1'__IGHJ6*01 | 2869 |
| 1015 | gi\|Fabrus\|VH3-23__IGHD4-4*01(1) > 1'__IGHJ6*01 | 2870 |
| 1016 | gi\|Fabrus\|VH3-23__IGHD4-4*01(1) > 3'__IGHJ6*01 | 2871 |

TABLE 3-continued

Exemplary Variable Heavy Chains and Light Chains

| Number | Name | SEQ ID NO. |
|---|---|---|
| 1017 | gi\|Fabrus\|VH3-23__IGHD4-11*01(1) > 1'__IGHJ6*01 | 2872 |
| 1018 | gi\|Fabrus\|VH3-23__IGHD4-11*01(1) > 3'__IGHJ6*01 | 2873 |
| 1019 | gi\|Fabrus\|VH3-23__IGHD4-17*01 > 1'__IGHJ6*01 | 2874 |
| 1020 | gi\|Fabrus\|VH3-23__IGHD4-17*01 > 3'__IGHJ6*01 | 2875 |
| 1021 | gi\|Fabrus\|VH3-23__IGHD4-23*01 > 1'__IGHJ6*01 | 2876 |
| 1022 | gi\|Fabrus\|VH3-23__IGHD4-23*01 > 3'__IGHJ6*01 | 2877 |
| 1023 | gi\|Fabrus\|VH3-23__IGHD5-5*01(2) > 1'__IGHJ6*01 | 2878 |
| 1024 | gi\|Fabrus\|VH3-23__IGHD5-5*01(2) > 3'__IGHJ6*01 | 2879 |
| 1025 | gi\|Fabrus\|VH3-23__IGHD5-12*01 > 1'__IGHJ6*01 | 2880 |
| 1026 | gi\|Fabrus\|VH3-23__IGHD5-12*01 > 3'__IGHJ6*01 | 2881 |
| 1027 | gi\|Fabrus\|VH3-23__IGHD5-18*01(2) > 1'__IGHJ6*01 | 2882 |
| 1028 | gi\|Fabrus\|VH3-23__IGHD5-18*01(2) > 3'__IGHJ6*01 | 2883 |
| 1029 | gi\|Fabrus\|VH3-23__IGHD5-24*01 > 1'__IGHJ6*01 | 2884 |
| 1030 | gi\|Fabrus\|VH3-23__IGHD5-24*01 > 3'__IGHJ6*01 | 2885 |
| 1031 | gi\|Fabrus\|VH3-23__IGHD6-6*01 > 1'__IGHJ6*01 | 2886 |
| 1032 | gi\|Fabrus\|VH3-23__IGHD6-6*01 > 2'__IGHJ6*01 | 2887 |
| 1033 | gi\|Fabrus\|VH3-23__IGHD6-6*01 > 3'__IGHJ6*01 | 2888 |
| 1034 | gi\|Fabrus\|VH3-23__IGHD6-13*01 > 1'__IGHJ6*01 | 2889 |
| 1035 | gi\|Fabrus\|VH3-23__IGHD6-13*01 > 2'__IGHJ6*01 | 2890 |
| 1036 | gi\|Fabrus\|VH3-23__IGHD6-13*01 > 3'__IGHJ6*01 | 2891 |
| 1037 | gi\|Fabrus\|VH3-23__IGHD6-19*01 > 1'__IGHJ6*01 | 2892 |
| 1038 | gi\|Fabrus\|VH3-23__IGHD6-19*01 > 2'__IGHJ6*01 | 2893 |
| 1039 | gi\|Fabrus\|VH3-23__IGHD6-19*01 > 3'__IGHJ6*01 | 2894 |
| 1040 | gi\|Fabrus\|VH3-23__IGHD6-25*01 > 1'__IGHJ6*01 | 2895 |
| 1041 | gi\|Fabrus\|VH3-23__IGHD6-25*01 > 3'__IGHJ6*01 | 2896 |
| 1042 | gi\|Fabrus\|VH3-23__IGHD7-27*01 > 1'__IGHJ6*01 | 2897 |
| 1043 | gi\|Fabrus\|VH3-23__IGHD7-27*01 > 2'__IGHJ6*01 | 2898 |

Light Chains

| Number | Name | SEQ ID NO. |
|---|---|---|
| 1 | gnl\|Fabrus\|A14__IGKJ1*01 | 2163 |
| 2 | gnl\|Fabrus\|A17__IGKJ1*01 | 113 |
| 3 | gnl\|Fabrus\|A2__IGKJ1*01 | 2164 |
| 4 | gnl\|Fabrus\|A20__IGKJ1*01 | 2165 |
| 5 | gnl\|Fabrus\|A23__IGKJ1*01 | 2166 |
| 6 | gnl\|Fabrus\|A26__IGKJ1*01 | 2167 |
| 7 | gnl\|Fabrus\|A27__IGKJ1*01 | 110 |
| 8 | gnl\|Fabrus\|A27__IGKJ3*01 | 2168 |
| 9 | gnl\|Fabrus\|A30__IGKJ1*01 | 2169 |
| 10 | gnl\|Fabrus\|B2__IGKJ1*01 | 2170 |
| 11 | gnl\|Fabrus\|B2__IGKJ3*01 | 2171 |
| 12 | gnl\|Fabrus\|B3__IGKJ1*01 | 111 |
| 13 | gnl\|Fabrus\|L11__IGKJ1*01 | 2173 |
| 14 | gnl\|Fabrus\|L12__IGKJ1*01 | 115 |
| 15 | gnl\|Fabrus\|L14__IGKJ1*01 | 2174 |
| 16 | gnl\|Fabrus\|L2__IGKJ1*01 | 112 |
| 17 | | |
| 18 | gnl\|Fabrus\|L22__IGKJ3*01 | 2175 |
| 19 | gnl\|Fabrus\|L23__IGKJ1*01 | 2176 |
| 20 | gnl\|Fabrus\|L25__IGKJ1*01 | 120 |
| 21 | gnl\|Fabrus\|L25__IGKJ3*01 | 2177 |
| 22 | gnl\|Fabrus\|L4/18a__IGKJ1*01 | 2178 |
| 23 | gnl\|Fabrus\|L5__IGKJ1*01 | 114 |
| 24 | gnl\|Fabrus\|L6__IGKJ1*01 | 107 |
| 25 | gnl\|Fabrus\|L8__IGKJ1*01 | 2179 |
| 26 | gnl\|Fabrus\|L9__IGKJ2*01 | 2180 |
| 27 | gnl\|Fabrus\|O1__IGKJ1*01 | 116 |
| 28 | gnl\|Fabrus\|O12__IGKJ1*01 | 119 |
| 29 | gnl\|Fabrus\|O18__IGKJ1*01 | 2181 |
| 31 | gnl\|Fabrus\|V1-11__IGLJ2*01 | 2183 |
| 32 | gnl\|Fabrus\|V1-13__IGLJ5*01 | 2184 |
| 33 | gnl\|Fabrus\|V1-16__IGLJ6*01 | 2185 |
| 34 | gnl\|Fabrus\|V1-18__IGLJ2*01 | 2186 |
| 35 | gnl\|Fabrus\|V1-2__IGLJ7*01 | 2187 |
| 36 | gnl\|Fabrus\|V1-20__IGLJ6*01 | 2188 |
| 37 | gnl\|Fabrus\|V1-3__IGLJ1*01 | 2189 |
| 38 | gnl\|Fabrus\|V1-4__IGLJ4*01 | 117 |
| 39 | gnl\|Fabrus\|V1-5__IGLJ2*01 | 2190 |
| 40 | gnl\|Fabrus\|V1-7__IGLJ1*01 | 2191 |
| 41 | gnl\|Fabrus\|V1-9__IGLJ6*01 | 2192 |
| 42 | gnl\|Fabrus\|V2-1__IGLJ6*01 | 2193 |
| 43 | gnl\|Fabrus\|V2-11__IGLJ7*01 | 2194 |
| 44 | gnl\|Fabrus\|V2-13__IGLJ2*01 | 2195 |
| 45 | gnl\|Fabrus\|V2-14__IGLJ4*01 | 2196 |
| 46 | gnl\|Fabrus\|V2-15__IGLJ7*01 | 2197 |
| 47 | gnl\|Fabrus\|V2-17__IGLJ2*01 | 2198 |
| 48 | gnl\|Fabrus\|V2-19__IGLJ4*01 | 2199 |
| 49 | gnl\|Fabrus\|V2-6__IGLJ4*01 | 2200 |
| 50 | gnl\|Fabrus\|V2-7__IGLJ2*01 | 2201 |
| 51 | gnl\|Fabrus\|V2-7__IGLJ7*01 | 2202 |
| 52 | gnl\|Fabrus\|V2-8__IGLJ6*01 | 2203 |
| 53 | gnl\|Fabrus\|V3-2__IGLJ4*01 | 2204 |
| 54 | gnl\|Fabrus\|V3-3__IGLJ7*01 | 2205 |
| 55 | gnl\|Fabrus\|V3-4__IGLJ1*01 | 108 |
| 56 | gnl\|Fabrus\|V4-1__IGLJ4*01 | 2206 |
| 57 | gnl\|Fabrus\|V4-2__IGLJ4*01 | 2207 |
| 58 | gnl\|Fabrus\|V4-3__IGLJ4*01 | 109 |
| 59 | gnl\|Fabrus\|V4-4__IGLJ5*01 | 2208 |
| 60 | gnl\|Fabrus\|V4-6__IGLJ4*01 | 118 |
| 61 | gnl\|Fabrus\|V5-4__IGLJ2*01 | 2209 |
| 62 | gnl\|Fabrus\|V5-6__IGLJ1*01 | 2210 |

TABLE 4

Exemplary Paired Nucleic Acid Library

| | HEAVY CHAIN | SEQ ID NO | LIGHT CHAIN | SEQ ID NO |
|---|---|---|---|---|
| 1 | gnl\|Fabrus\|VH3-23__IGHD1-1*01__IGHJ4*01 | 863 | gnl\|Fabrus\|O12__IGKJ1*01 | 1101 |
| 2 | gnl\|Fabrus\|VH3-23__IGHD2-15*01__IGHJ4*01 | 866 | gnl\|Fabrus\|O12__IGKJ1*01 | 1101 |
| 3 | gnl\|Fabrus\|VH3-23__IGHD3-22*01__IGHJ4*01 | 870 | gnl\|Fabrus\|O12__IGKJ1*01 | 1101 |
| 4 | gnl\|Fabrus\|VH3-23__IGHD4-11*01__IGHJ4*01 | 872 | gnl\|Fabrus\|O12__IGKJ1*01 | 1101 |
| 5 | gnl\|Fabrus\|VH3-23__IGHD5-12*01__IGHJ4*01 | 874 | gnl\|Fabrus\|O12__IGKJ1*01 | 1101 |
| 6 | gnl\|Fabrus\|VH3-23__IGHD5-5*01__IGHJ4*01 | 876 | gnl\|Fabrus\|O12__IGKJ1*01 | 1101 |
| 7 | gnl\|Fabrus\|VH3-23__IGHD6-13*01__IGHJ4*01 | 877 | gnl\|Fabrus\|O12__IGKJ1*01 | 1101 |
| 8 | gnl\|Fabrus\|VH3-23__IGHD7-27*01__IGHJ4*01 | 880 | gnl\|Fabrus\|O12__IGKJ1*01 | 1101 |
| 9 | gnl\|Fabrus\|VH3-23__IGHD7-27*01__IGHJ6*01 | 881 | gnl\|Fabrus\|O12__IGKJ1*01 | 1101 |
| 10 | gnl\|Fabrus\|VH1-69__IGHD1-14*01__IGHJ4*01 | 770 | gnl\|Fabrus\|O12__IGKJ1*01 | 1101 |
| 11 | gnl\|Fabrus\|VH1-69__IGHD2-2*01__IGHJ4*01 | 771 | gnl\|Fabrus\|O12__IGKJ1*01 | 1101 |
| 12 | gnl\|Fabrus\|VH1-69__IGHD2-8*01__IGHJ6*01 | 772 | gnl\|Fabrus\|O12__IGKJ1*01 | 1101 |
| 13 | gnl\|Fabrus\|VH1-69__IGHD3-16*01__IGHJ4*01 | 773 | gnl\|Fabrus\|O12__IGKJ1*01 | 1101 |
| 14 | gnl\|Fabrus\|VH1-69__IGHD3-3*01__IGHJ4*01 | 774 | gnl\|Fabrus\|O12__IGKJ1*01 | 1101 |
| 15 | gnl\|Fabrus\|VH1-69__IGHD4-17*01__IGHJ4*01 | 776 | gnl\|Fabrus\|O12__IGKJ1*01 | 1101 |
| 16 | gnl\|Fabrus\|VH1-69__IGHD5-12*01__IGHJ4*01 | 777 | gnl\|Fabrus\|O12__IGKJ1*01 | 1101 |
| 17 | gnl\|Fabrus\|VH1-69__IGHD6-19*01__IGHJ4*01 | 779 | gnl\|Fabrus\|O12__IGKJ1*01 | 1101 |
| 18 | gnl\|Fabrus\|VH1-69__IGHD7-27*01__IGHJ4*01 | 781 | gnl\|Fabrus\|O12__IGKJ1*01 | 1101 |
| 19 | gnl\|Fabrus\|VH4-34__IGHD1-7*01__IGHJ4*01 | 1017 | gnl\|Fabrus\|O12__IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 20 | gnl\|Fabrus\|VH4-34__IGHD2-2*01__IGHJ4*01 | 1018 | gnl\|Fabrus\|O12__IGKJ1*01 | 1101 |
| 21 | gnl\|Fabrus\|VH4-34__IGHD3-16*01__IGHJ4*01 | 1019 | gnl\|Fabrus\|O12__IGKJ1*01 | 1101 |
| 22 | gnl\|Fabrus\|VH4-34__IGHD4-17*01__IGHJ4*01 | 1021 | gnl\|Fabrus\|O12__IGKJ1*01 | 1101 |
| 23 | gnl\|Fabrus\|VH4-34__IGHD5-12*01__IGHJ4*01 | 1022 | gnl\|Fabrus\|O12__IGKJ1*01 | 1101 |
| 24 | gnl\|Fabrus\|VH4-34__IGHD6-13*01__IGHJ4*01 | 1023 | gnl\|Fabrus\|O12__IGKJ1*01 | 1101 |
| 25 | gnl\|Fabrus\|VH4-34__IGHD6-25*01__IGHJ6*01 | 1024 | gnl\|Fabrus\|O12__IGKJ1*01 | 1101 |
| 26 | gnl\|Fabrus\|VH4-34__IGHD7-27*01__IGHJ4*01 | 1026 | gnl\|Fabrus\|O12__IGKJ1*01 | 1101 |
| 27 | gnl\|Fabrus\|VH2-26__IGHD1-20*01__IGHJ4*01 | 789 | gnl\|Fabrus\|O12__IGKJ1*01 | 1101 |
| 28 | gnl\|Fabrus\|VH2-26__IGHD2-2*01__IGHJ4*01 | 791 | gnl\|Fabrus\|O12__IGKJ1*01 | 1101 |
| 29 | gnl\|Fabrus\|VH2-26__IGHD3-10*01__IGHJ4*01 | 792 | gnl\|Fabrus\|O12__IGKJ1*01 | 1101 |
| 30 | gnl\|Fabrus\|VH2-26__IGHD4-11*01__IGHJ4*01 | 794 | gnl\|Fabrus\|O12__IGKJ1*01 | 1101 |
| 31 | gnl\|Fabrus\|VH2-26__IGHD5-18*01__IGHJ4*01 | 796 | gnl\|Fabrus\|O12__IGKJ1*01 | 1101 |
| 32 | gnl\|Fabrus\|VH2-26__IGHD6-13*01__IGHJ4*01 | 797 | gnl\|Fabrus\|O12__IGKJ1*01 | 1101 |
| 33 | gnl\|Fabrus\|VH2-26__IGHD7-27*01__IGHJ4*01 | 798 | gnl\|Fabrus\|O12__IGKJ1*01 | 1101 |
| 34 | gnl\|Fabrus\|VH5-51__IGHD1-14*01__IGHJ4*01 | 1044 | gnl\|Fabrus\|O12__IGKJ1*01 | 1101 |
| 35 | gnl\|Fabrus\|VH5-51__IGHD2-8*01__IGHJ4*01 | 1046 | gnl\|Fabrus\|O12__IGKJ1*01 | 1101 |
| 36 | gnl\|Fabrus\|VH5-51__IGHD3-3*01__IGHJ4*01 | 1048 | gnl\|Fabrus\|O12__IGKJ1*01 | 1101 |
| 37 | gnl\|Fabrus\|VH5-51__IGHD4-17*01__IGHJ4*01 | 1049 | gnl\|Fabrus\|O12__IGKJ1*01 | 1101 |
| 38 | gnl\|Fabrus\|VH5-51__IGHD5-18*01 > 3__IGHJ4*01 | 1050 | gnl\|Fabrus\|O12__IGKJ1*01 | 1101 |
| 39 | gnl\|Fabrus\|VH5-51__IGHD5-18*01 > 1__IGHJ4*01 | 1051 | gnl\|Fabrus\|O12__IGKJ1*01 | 1101 |
| 40 | gnl\|Fabrus\|VH5-51__IGHD6-25*01__IGHJ4*01 | 1052 | gnl\|Fabrus\|O12__IGKJ1*01 | 1101 |
| 41 | gnl\|Fabrus\|VH5-51__IGHD7-27*01__IGHJ4*01 | 1053 | gnl\|Fabrus\|O12__IGKJ1*01 | 1101 |
| 42 | gnl\|Fabrus\|VH6-1__IGHD1-1*01__IGHJ4*01 | 1054 | gnl\|Fabrus\|O12__IGKJ1*01 | 1101 |
| 43 | gnl\|Fabrus\|VH6-1__IGHD2-15*01__IGHJ4*01 | 1056 | gnl\|Fabrus\|O12__IGKJ1*01 | 1101 |
| 44 | gnl\|Fabrus\|VH6-1__IGHD3-3*01__IGHJ4*01 | 1059 | gnl\|Fabrus\|O12__IGKJ1*01 | 1101 |
| 45 | gnl\|Fabrus\|VH6-1__IGHD4-23*01__IGHJ4*01 | 1061 | gnl\|Fabrus\|O12__IGKJ1*01 | 1101 |
| 46 | gnl\|Fabrus\|VH6-1__IGHD4-11*01__IGHJ6*01 | 1060 | gnl\|Fabrus\|O12__IGKJ1*01 | 1101 |
| 47 | gnl\|Fabrus\|VH6-1__IGHD5-5*01__IGHJ4*01 | 1062 | gnl\|Fabrus\|O12__IGKJ1*01 | 1101 |
| 48 | gnl\|Fabrus\|VH6-1__IGHD6-13*01__IGHJ4*01 | 1063 | gnl\|Fabrus\|O12__IGKJ1*01 | 1101 |
| 49 | gnl\|Fabrus\|VH6-1__IGHD6-25*01__IGHJ6*01 | 1064 | gnl\|Fabrus\|O12__IGKJ1*01 | 1101 |
| 50 | gnl\|Fabrus\|VH6-1__IGHD7-27*01__IGHJ4*01 | 1065 | gnl\|Fabrus\|O12__IGKJ1*01 | 1101 |
| 51 | gnl\|Fabrus\|VH4-59__IGHD6-25*01__IGHJ3*01 | 1043 | gnl\|Fabrus\|O12__IGKJ1*01 | 1101 |
| 52 | gnl\|Fabrus\|VH3-48__IGHD6-6*01__IGHJ1*01 | 923 | gnl\|Fabrus\|O12__IGKJ1*01 | 1101 |
| 53 | gnl\|Fabrus\|VH3-30__IGHD6-6*01__IGHJ1*01 | 893 | gnl\|Fabrus\|O12__IGKJ1*01 | 1101 |
| 54 | gnl\|Fabrus\|VH3-66__IGHD6-6*01__IGHJ1*01 | 949 | gnl\|Fabrus\|O12__IGKJ1*01 | 1101 |
| 55 | gnl\|Fabrus\|VH3-53__IGHD5-5*01__IGHJ4*01 | 938 | gnl\|Fabrus\|O12__IGKJ1*01 | 1101 |
| 56 | gnl\|Fabrus\|VH2-5__IGHD5-12*01__IGHJ4*01 | 804 | gnl\|Fabrus\|O12__IGKJ1*01 | 1101 |
| 57 | gnl\|Fabrus\|VH2-70__IGHD5-12*01__IGHJ4*01 | 811 | gnl\|Fabrus\|O12__IGKJ1*01 | 1101 |
| 58 | gnl\|Fabrus\|VH3-15__IGHD5-12*01__IGHJ4*01 | 835 | gnl\|Fabrus\|O12__IGKJ1*01 | 1101 |
| 59 | gnl\|Fabrus\|VH3-15__IGHD3-10*01__IGHJ4*01 | 833 | gnl\|Fabrus\|O12__IGKJ1*01 | 1101 |
| 60 | gnl\|Fabrus\|VH3-49__IGHD5-18*01__IGHJ4*01 | 930 | gnl\|Fabrus\|O12__IGKJ1*01 | 1101 |
| 61 | gnl\|Fabrus\|VH3-49__IGHD6-13*01__IGHJ4*01 | 931 | gnl\|Fabrus\|O12__IGKJ1*01 | 1101 |
| 62 | gnl\|Fabrus\|VH3-72__IGHD5-18*01__IGHJ4*01 | 967 | gnl\|Fabrus\|O12__IGKJ1*01 | 1101 |
| 63 | gnl\|Fabrus\|VH3-72__IGHD6-6*01__IGHJ1*01 | 969 | gnl\|Fabrus\|O12__IGKJ1*01 | 1101 |
| 64 | gnl\|Fabrus\|VH3-73__IGHD5-12*01__IGHJ4*01 | 977 | gnl\|Fabrus\|O12__IGKJ1*01 | 1101 |
| 65 | gnl\|Fabrus\|VH3-73__IGHD4-23*01__IGHJ5*01 | 976 | gnl\|Fabrus\|O12__IGKJ1*01 | 1101 |
| 66 | gnl\|Fabrus\|VH3-43__IGHD3-22*01__IGHJ4*01 | 918 | gnl\|Fabrus\|O12__IGKJ1*01 | 1101 |
| 67 | gnl\|Fabrus\|VH3-43__IGHD6-13*01__IGHJ4*01 | 921 | gnl\|Fabrus\|O12__IGKJ1*01 | 1101 |
| 68 | gnl\|Fabrus\|VH3-9__IGHD3-22*01__IGHJ4*01 | 992 | gnl\|Fabrus\|O12__IGKJ1*01 | 1101 |
| 69 | gnl\|Fabrus\|VH3-9__IGHD1-7*01__IGHJ5*01 | 989 | gnl\|Fabrus\|O12__IGKJ1*01 | 1101 |
| 70 | gnl\|Fabrus\|VH3-9__IGHD6-13*01__IGHJ4*01 | 995 | gnl\|Fabrus\|O12__IGKJ1*01 | 1101 |
| 71 | gnl\|Fabrus\|VH4-39__IGHD3-10*01__IGHJ4*01 | 1030 | gnl\|Fabrus\|O12__IGKJ1*01 | 1101 |
| 72 | gnl\|Fabrus\|VH4-39__IGHD5-12*01__IGHJ4*01 | 1034 | gnl\|Fabrus\|O12__IGKJ1*01 | 1101 |
| 73 | gnl\|Fabrus\|VH1-18__IGHD6-6*01__IGHJ1*01 | 728 | gnl\|Fabrus\|O12__IGKJ1*01 | 1101 |
| 74 | gnl\|Fabrus\|VH1-24__IGHD5-12*01__IGHJ4*01 | 735 | gnl\|Fabrus\|O12__IGKJ1*01 | 1101 |
| 75 | gnl\|Fabrus\|VH1-2__IGHD1-1*01__IGHJ3*01 | 729 | gnl\|Fabrus\|O12__IGKJ1*01 | 1101 |
| 76 | gnl\|Fabrus\|VH1-3__IGHD6-6*01__IGHJ1*01 | 743 | gnl\|Fabrus\|O12__IGKJ1*01 | 1101 |
| 77 | gnl\|Fabrus\|VH1-45__IGHD3-10*01__IGHJ4*01 | 748 | gnl\|Fabrus\|O12__IGKJ1*01 | 1101 |
| 78 | gnl\|Fabrus\|VH1-46__IGHD1-26*01__IGHJ4*01 | 754 | gnl\|Fabrus\|O12__IGKJ1*01 | 1101 |
| 79 | gnl\|Fabrus\|VH7-81__IGHD2-21*01__IGHJ6*01 | 1068 | gnl\|Fabrus\|O12__IGKJ1*01 | 1101 |
| 80 | gnl\|Fabrus\|VH2-70__IGHD3-9*01__IGHJ6*01 | 810 | gnl\|Fabrus\|O12__IGKJ1*01 | 1101 |
| 81 | gnl\|Fabrus\|VH1-58__IGHD3-10*01__IGHJ6*01 | 764 | gnl\|Fabrus\|O12__IGKJ1*01 | 1101 |
| 82 | gnl\|Fabrus\|VH7-81__IGHD2-21*01__IGHJ2*01 | 1067 | gnl\|Fabrus\|O12__IGKJ1*01 | 1101 |
| 83 | gnl\|Fabrus\|VH4-28__IGHD3-9*01__IGHJ6*01 | 1002 | gnl\|Fabrus\|O12__IGKJ1*01 | 1101 |
| 84 | gnl\|Fabrus\|VH4-31__IGHD2-15*01__IGHJ2*01 | 1008 | gnl\|Fabrus\|O12__IGKJ1*01 | 1101 |
| 85 | gnl\|Fabrus\|VH2-5__IGHD3-9*01__IGHJ6*01 | 803 | gnl\|Fabrus\|O12__IGKJ1*01 | 1101 |
| 86 | gnl\|Fabrus\|VH1-8__IGHD2-15*01__IGHJ6*01 | 783 | gnl\|Fabrus\|O12__IGKJ1*01 | 1101 |
| 87 | gnl\|Fabrus\|VH2-70__IGHD2-15*01__IGHJ2*01 | 808 | gnl\|Fabrus\|O12__IGKJ1*01 | 1101 |
| 88 | gnl\|Fabrus\|VH3-38__IGHD3-10*01__IGHJ4*01 | 907 | gnl\|Fabrus\|O12__IGKJ1*01 | 1101 |
| 89 | gnl\|Fabrus\|VH3-16__IGHD1-7*01__IGHJ6*01 | 838 | gnl\|Fabrus\|O12__IGKJ1*01 | 1101 |
| 90 | gnl\|Fabrus\|VH3-73__IGHD3-9*01__IGHJ6*01 | 974 | gnl\|Fabrus\|O12__IGKJ1*01 | 1101 |
| 91 | gnl\|Fabrus\|VH3-11__IGHD3-9*01__IGHJ6*01 | 816 | gnl\|Fabrus\|O12__IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 92 | gnl\|Fabrus\|VH3-11__IGHD6-6*01__IGHJ1*01 | 820 | gnl\|Fabrus\|O12__IGKJ1*01 | 1101 |
| 93 | gnl\|Fabrus\|VH3-20__IGHD5-12*01__IGHJ4*01 | 852 | gnl\|Fabrus\|O12__IGKJ1*01 | 1101 |
| 94 | gnl\|Fabrus\|VH3-16__IGHD2-15*01__IGHJ2*01 | 839 | gnl\|Fabrus\|O12__IGKJ1*01 | 1101 |
| 95 | gnl\|Fabrus\|VH3-7__IGHD6-6*01__IGHJ1*01 | 960 | gnl\|Fabrus\|O12__IGKJ1*01 | 1101 |
| 96 | gnl\|Fabrus\|VH3-16__IGHD6-13*01__IGHJ4*01 | 844 | gnl\|Fabrus\|O12__IGKJ1*01 | 1101 |
| 97 | gnl\|Fabrus\|VH3-23__IGHD1-1*01__IGHJ4*01 | 863 | gnl\|Fabrus\|O18__IGKJ1*01 | 1102 |
| 98 | gnl\|Fabrus\|VH3-23__IGHD2-15*01__IGHJ4*01 | 866 | gnl\|Fabrus\|O18__IGKJ1*01 | 1102 |
| 99 | gnl\|Fabrus\|VH3-23__IGHD3-22*01__IGHJ4*01 | 870 | gnl\|Fabrus\|O18__IGKJ1*01 | 1102 |
| 100 | gnl\|Fabrus\|VH3-23__IGHD4-11*01__IGHJ4*01 | 872 | gnl\|Fabrus\|O18__IGKJ1*01 | 1102 |
| 101 | gnl\|Fabrus\|VH3-23__IGHD5-12*01__IGHJ4*01 | 874 | gnl\|Fabrus\|O18__IGKJ1*01 | 1102 |
| 102 | gnl\|Fabrus\|VH3-23__IGHD5-5*01__IGHJ4*01 | 876 | gnl\|Fabrus\|O18__IGKJ1*01 | 1102 |
| 103 | gnl\|Fabrus\|VH3-23__IGHD6-13*01__IGHJ4*01 | 877 | gnl\|Fabrus\|O18__IGKJ1*01 | 1102 |
| 104 | gnl\|Fabrus\|VH3-23__IGHD7-27*01__IGHJ4*01 | 880 | gnl\|Fabrus\|O18__IGKJ1*01 | 1102 |
| 105 | gnl\|Fabrus\|VH3-23__IGHD7-27*01__IGHJ6*01 | 881 | gnl\|Fabrus\|O18__IGKJ1*01 | 1102 |
| 106 | gnl\|Fabrus\|VH1-69__IGHD1-14*01__IGHJ4*01 | 770 | gnl\|Fabrus\|O18__IGKJ1*01 | 1102 |
| 107 | gnl\|Fabrus\|VH1-69__IGHD2-2*01__IGHJ4*01 | 771 | gnl\|Fabrus\|O18__IGKJ1*01 | 1102 |
| 108 | gnl\|Fabrus\|VH1-69__IGHD2-8*01__IGHJ6*01 | 772 | gnl\|Fabrus\|O18__IGKJ1*01 | 1102 |
| 109 | gnl\|Fabrus\|VH1-69__IGHD3-16*01__IGHJ4*01 | 773 | gnl\|Fabrus\|O18__IGKJ1*01 | 1102 |
| 110 | gnl\|Fabrus\|VH1-69__IGHD3-3*01__IGHJ4*01 | 774 | gnl\|Fabrus\|O18__IGKJ1*01 | 1102 |
| 111 | gnl\|Fabrus\|VH1-69__IGHD4-17*01__IGHJ4*01 | 776 | gnl\|Fabrus\|O18__IGKJ1*01 | 1102 |
| 112 | gnl\|Fabrus\|VH1-69__IGHD5-12*01__IGHJ4*01 | 777 | gnl\|Fabrus\|O18__IGKJ1*01 | 1102 |
| 113 | gnl\|Fabrus\|VH1-69__IGHD6-19*01__IGHJ4*01 | 779 | gnl\|Fabrus\|O18__IGKJ1*01 | 1102 |
| 114 | gnl\|Fabrus\|VH1-69__IGHD7-27*01__IGHJ4*01 | 781 | gnl\|Fabrus\|O18__IGKJ1*01 | 1102 |
| 115 | gnl\|Fabrus\|VH4-34__IGHD1-7*01__IGHJ4*01 | 1017 | gnl\|Fabrus\|O18__IGKJ1*01 | 1102 |
| 116 | gnl\|Fabrus\|VH4-34__IGHD2-2*01__IGHJ4*01 | 1018 | gnl\|Fabrus\|O18__IGKJ1*01 | 1102 |
| 117 | gnl\|Fabrus\|VH4-34__IGHD3-16*01__IGHJ4*01 | 1019 | gnl\|Fabrus\|O18__IGKJ1*01 | 1102 |
| 118 | gnl\|Fabrus\|VH4-34__IGHD4-17*01__IGHJ4*01 | 1021 | gnl\|Fabrus\|O18__IGKJ1*01 | 1102 |
| 119 | gnl\|Fabrus\|VH4-34__IGHD5-12*01__IGHJ4*01 | 1022 | gnl\|Fabrus\|O18__IGKJ1*01 | 1102 |
| 120 | gnl\|Fabrus\|VH4-34__IGHD6-13*01__IGHJ4*01 | 1023 | gnl\|Fabrus\|O18__IGKJ1*01 | 1102 |
| 121 | gnl\|Fabrus\|VH4-34__IGHD6-25*01__IGHJ6*01 | 1024 | gnl\|Fabrus\|O18__IGKJ1*01 | 1102 |
| 122 | gnl\|Fabrus\|VH4-34__IGHD7-27*01__IGHJ4*01 | 1026 | gnl\|Fabrus\|O18__IGKJ1*01 | 1102 |
| 123 | gnl\|Fabrus\|VH2-26__IGHD1-20*01__IGHJ4*01 | 789 | gnl\|Fabrus\|O18__IGKJ1*01 | 1102 |
| 124 | gnl\|Fabrus\|VH2-26__IGHD2-2*01__IGHJ4*01 | 791 | gnl\|Fabrus\|O18__IGKJ1*01 | 1102 |
| 125 | gnl\|Fabrus\|VH2-26__IGHD3-10*01__IGHJ4*01 | 792 | gnl\|Fabrus\|O18__IGKJ1*01 | 1102 |
| 126 | gnl\|Fabrus\|VH2-26__IGHD4-11*01__IGHJ4*01 | 794 | gnl\|Fabrus\|O18__IGKJ1*01 | 1102 |
| 127 | gnl\|Fabrus\|VH2-26__IGHD5-18*01__IGHJ4*01 | 796 | gnl\|Fabrus\|O18__IGKJ1*01 | 1102 |
| 128 | gnl\|Fabrus\|VH2-26__IGHD6-13*01__IGHJ4*01 | 797 | gnl\|Fabrus\|O18__IGKJ1*01 | 1102 |
| 129 | gnl\|Fabrus\|VH2-26__IGHD7-27*01__IGHJ4*01 | 798 | gnl\|Fabrus\|O18__IGKJ1*01 | 1102 |
| 130 | gnl\|Fabrus\|VH5-51__IGHD1-14*01__IGHJ4*01 | 1044 | gnl\|Fabrus\|O18__IGKJ1*01 | 1102 |
| 131 | gnl\|Fabrus\|VH5-51__IGHD2-8*01__IGHJ4*01 | 1046 | gnl\|Fabrus\|O18__IGKJ1*01 | 1102 |
| 132 | gnl\|Fabrus\|VH5-51__IGHD3-3*01__IGHJ4*01 | 1048 | gnl\|Fabrus\|O18__IGKJ1*01 | 1102 |
| 133 | gnl\|Fabrus\|VH5-51__IGHD4-17*01__IGHJ4*01 | 1049 | gnl\|Fabrus\|O18__IGKJ1*01 | 1102 |
| 134 | gnl\|Fabrus\|VH5-51__IGHD5-18*01__IGHJ4*01 | 1050 | gnl\|Fabrus\|O18__IGKJ1*01 | 1102 |
| 135 | gnl\|Fabrus\|VH5-51__IGHD5-18*01__IGHJ4*01 | 1051 | gnl\|Fabrus\|O18__IGKJ1*01 | 1102 |
| 136 | gnl\|Fabrus\|VH5-51__IGHD6-25*01__IGHJ4*01 | 1052 | gnl\|Fabrus\|O18__IGKJ1*01 | 1102 |
| 137 | gnl\|Fabrus\|VH5-51__IGHD7-27*01__IGHJ4*01 | 1053 | gnl\|Fabrus\|O18__IGKJ1*01 | 1102 |
| 138 | gnl\|Fabrus\|VH6-1__IGHD1-1*01__IGHJ4*01 | 1054 | gnl\|Fabrus\|O18__IGKJ1*01 | 1102 |
| 139 | gnl\|Fabrus\|VH6-1__IGHD2-15*01__IGHJ4*01 | 1056 | gnl\|Fabrus\|O18__IGKJ1*01 | 1102 |
| 140 | gnl\|Fabrus\|VH6-1__IGHD3-3*01__IGHJ4*01 | 1059 | gnl\|Fabrus\|O18__IGKJ1*01 | 1102 |
| 141 | gnl\|Fabrus\|VH6-1__IGHD4-23*01__IGHJ4*01 | 1061 | gnl\|Fabrus\|O18__IGKJ1*01 | 1102 |
| 142 | gnl\|Fabrus\|VH6-1__IGHD4-11*01__IGHJ6*01 | 1060 | gnl\|Fabrus\|O18__IGKJ1*01 | 1102 |
| 143 | gnl\|Fabrus\|VH6-1__IGHD5-5*01__IGHJ4*01 | 1062 | gnl\|Fabrus\|O18__IGKJ1*01 | 1102 |
| 144 | gnl\|Fabrus\|VH6-1__IGHD6-13*01__IGHJ4*01 | 1063 | gnl\|Fabrus\|O18__IGKJ1*01 | 1102 |
| 145 | gnl\|Fabrus\|VH6-1__IGHD6-25*01__IGHJ6*01 | 1064 | gnl\|Fabrus\|O18__IGKJ1*01 | 1102 |
| 146 | gnl\|Fabrus\|VH6-1__IGHD7-27*01__IGHJ4*01 | 1065 | gnl\|Fabrus\|O18__IGKJ1*01 | 1102 |
| 147 | gnl\|Fabrus\|VH4-59__IGHD6-25*01__IGHJ3*01 | 1043 | gnl\|Fabrus\|O18__IGKJ1*01 | 1102 |
| 148 | gnl\|Fabrus\|VH3-48__IGHD6-6*01__IGHJ1*01 | 923 | gnl\|Fabrus\|O18__IGKJ1*01 | 1102 |
| 149 | gnl\|Fabrus\|VH3-30__IGHD6-6*01__IGHJ1*01 | 893 | gnl\|Fabrus\|O18__IGKJ1*01 | 1102 |
| 150 | gnl\|Fabrus\|VH3-66__IGHD6-6*01__IGHJ1*01 | 949 | gnl\|Fabrus\|O18__IGKJ1*01 | 1102 |
| 151 | gnl\|Fabrus\|VH3-53__IGHD5-5*01__IGHJ4*01 | 938 | gnl\|Fabrus\|O18__IGKJ1*01 | 1102 |
| 152 | gnl\|Fabrus\|VH2-5__IGHD5-12*01__IGHJ4*01 | 804 | gnl\|Fabrus\|O18__IGKJ1*01 | 1102 |
| 153 | gnl\|Fabrus\|VH2-70__IGHD5-12*01__IGHJ4*01 | 811 | gnl\|Fabrus\|O18__IGKJ1*01 | 1102 |
| 154 | gnl\|Fabrus\|VH3-15__IGHD5-12*01__IGHJ4*01 | 835 | gnl\|Fabrus\|O18__IGKJ1*01 | 1102 |
| 155 | gnl\|Fabrus\|VH3-15__IGHD3-10*01__IGHJ4*01 | 833 | gnl\|Fabrus\|O18__IGKJ1*01 | 1102 |
| 156 | gnl\|Fabrus\|VH3-49__IGHD5-18*01__IGHJ4*01 | 930 | gnl\|Fabrus\|O18__IGKJ1*01 | 1102 |
| 157 | gnl\|Fabrus\|VH3-49__IGHD6-13*01__IGHJ4*01 | 931 | gnl\|Fabrus\|O18__IGKJ1*01 | 1102 |
| 158 | gnl\|Fabrus\|VH3-72__IGHD5-18*01__IGHJ4*01 | 967 | gnl\|Fabrus\|O18__IGKJ1*01 | 1102 |
| 159 | gnl\|Fabrus\|VH3-72__IGHD6-6*01__IGHJ1*01 | 969 | gnl\|Fabrus\|O18__IGKJ1*01 | 1102 |
| 160 | gnl\|Fabrus\|VH3-73__IGHD5-12*01__IGHJ4*01 | 977 | gnl\|Fabrus\|O18__IGKJ1*01 | 1102 |
| 161 | gnl\|Fabrus\|VH3-73__IGHD4-23*01__IGHJ5*01 | 976 | gnl\|Fabrus\|O18__IGKJ1*01 | 1102 |
| 162 | gnl\|Fabrus\|VH3-43__IGHD3-22*01__IGHJ4*01 | 918 | gnl\|Fabrus\|O18__IGKJ1*01 | 1102 |
| 163 | gnl\|Fabrus\|VH3-43__IGHD6-13*01__IGHJ4*01 | 921 | gnl\|Fabrus\|O18__IGKJ1*01 | 1102 |
| 164 | gnl\|Fabrus\|VH3-9__IGHD3-22*01__IGHJ4*01 | 992 | gnl\|Fabrus\|O18__IGKJ1*01 | 1102 |
| 165 | gnl\|Fabrus\|VH3-9__IGHD1-7*01__IGHJ5*01 | 989 | gnl\|Fabrus\|O18__IGKJ1*01 | 1102 |

TABLE 4-continued

Exemplary Paired Nucleic Acid Library

| | HEAVY CHAIN | SEQ ID NO | LIGHT CHAIN | SEQ ID NO |
|---|---|---|---|---|
| 166 | gnl|Fabrus|VH3-9__IGHD6-13*01__IGHJ4*01 | 995 | gnl|Fabrus|O18__IGKJ1*01 | 1102 |
| 167 | gnl|Fabrus|VH4-39__IGHD3-10*01__IGHJ4*01 | 1030 | gnl|Fabrus|O18__IGKJ1*01 | 1102 |
| 168 | gnl|Fabrus|VH4-39__IGHD5-12*01__IGHJ4*01 | 1034 | gnl|Fabrus|O18__IGKJ1*01 | 1102 |
| 169 | gnl|Fabrus|VH1-18__IGHD6-6*01__IGHJ1*01 | 728 | gnl|Fabrus|O18__IGKJ1*01 | 1102 |
| 170 | gnl|Fabrus|VH1-24__IGHD5-12*01__IGHJ4*01 | 735 | gnl|Fabrus|O18__IGKJ1*01 | 1102 |
| 171 | gnl|Fabrus|VH1-2__IGHD1-1*01__IGHJ3*01 | 729 | gnl|Fabrus|O18__IGKJ1*01 | 1102 |
| 172 | gnl|Fabrus|VH1-3__IGHD6-6*01__IGHJ1*01 | 743 | gnl|Fabrus|O18__IGKJ1*01 | 1102 |
| 173 | gnl|Fabrus|VH1-45__IGHD3-10*01__IGHJ4*01 | 748 | gnl|Fabrus|O18__IGKJ1*01 | 1102 |
| 174 | gnl|Fabrus|VH1-46__IGHD1-26*01__IGHJ4*01 | 754 | gnl|Fabrus|O18__IGKJ1*01 | 1102 |
| 175 | gnl|Fabrus|VH7-81__IGHD2-21*01__IGHJ6*01 | 1068 | gnl|Fabrus|O18__IGKJ1*01 | 1102 |
| 176 | gnl|Fabrus|VH2-70__IGHD3-9*01__IGHJ6*01 | 810 | gnl|Fabrus|O18__IGKJ1*01 | 1102 |
| 177 | gnl|Fabrus|VH1-58__IGHD3-10*01__IGHJ6*01 | 764 | gnl|Fabrus|O18__IGKJ1*01 | 1102 |
| 178 | gnl|Fabrus|VH7-81__IGHD2-21*01__IGHJ2*01 | 1067 | gnl|Fabrus|O18__IGKJ1*01 | 1102 |
| 179 | gnl|Fabrus|VH4-28__IGHD3-9*01__IGHJ6*01 | 1002 | gnl|Fabrus|O18__IGKJ1*01 | 1102 |
| 180 | gnl|Fabrus|VH4-31__IGHD2-15*01__IGHJ2*01 | 1008 | gnl|Fabrus|O18__IGKJ1*01 | 1102 |
| 181 | gnl|Fabrus|VH2-5__IGHD3-9*01__IGHJ6*01 | 803 | gnl|Fabrus|O18__IGKJ1*01 | 1102 |
| 182 | gnl|Fabrus|VH1-8__IGHD2-15*01__IGHJ6*01 | 783 | gnl|Fabrus|O18__IGKJ1*01 | 1102 |
| 183 | gnl|Fabrus|VH2-70__IGHD2-15*01__IGHJ2*01 | 808 | gnl|Fabrus|O18__IGKJ1*01 | 1102 |
| 184 | gnl|Fabrus|VH3-38__IGHD3-10*01__IGHJ4*01 | 907 | gnl|Fabrus|O18__IGKJ1*01 | 1102 |
| 185 | gnl|Fabrus|VH3-16__IGHD1-7*01__IGHJ6*01 | 838 | gnl|Fabrus|O18__IGKJ1*01 | 1102 |
| 186 | gnl|Fabrus|VH3-73__IGHD3-9*01__IGHJ6*01 | 974 | gnl|Fabrus|O18__IGKJ1*01 | 1102 |
| 187 | gnl|Fabrus|VH3-11__IGHD3-9*01__IGHJ6*01 | 816 | gnl|Fabrus|O18__IGKJ1*01 | 1102 |
| 188 | gnl|Fabrus|VH3-11__IGHD6-6*01__IGHJ1*01 | 820 | gnl|Fabrus|O18__IGKJ1*01 | 1102 |
| 189 | gnl|Fabrus|VH3-20__IGHD5-12*01__IGHJ4*01 | 852 | gnl|Fabrus|O18__IGKJ1*01 | 1102 |
| 190 | gnl|Fabrus|VH3-16__IGHD2-15*01__IGHJ2*01 | 839 | gnl|Fabrus|O18__IGKJ1*01 | 1102 |
| 191 | gnl|Fabrus|VH3-7__IGHD6-6*01__IGHJ1*01 | 960 | gnl|Fabrus|O18__IGKJ1*01 | 1102 |
| 192 | gnl|Fabrus|VH3-16__IGHD6-13*01__IGHJ4*01 | 844 | gnl|Fabrus|O18__IGKJ1*01 | 1102 |
| 193 | gnl|Fabrus|VH3-23__IGHD1-1*01__IGHJ4*01 | 863 | gnl|Fabrus|A20__IGKJ1*01 | 1077 |
| 194 | gnl|Fabrus|VH3-23__IGHD2-15*01__IGHJ4*01 | 866 | gnl|Fabrus|A20__IGKJ1*01 | 1077 |
| 195 | gnl|Fabrus|VH3-23__IGHD3-22*01__IGHJ4*01 | 870 | gnl|Fabrus|A20__IGKJ1*01 | 1077 |
| 196 | gnl|Fabrus|VH3-23__IGHD4-11*01__IGHJ4*01 | 872 | gnl|Fabrus|A20__IGKJ1*01 | 1077 |
| 197 | gnl|Fabrus|VH3-23__IGHD5-12*01__IGHJ4*01 | 874 | gnl|Fabrus|A20__IGKJ1*01 | 1077 |
| 198 | gnl|Fabrus|VH3-23__IGHD5-5*01__IGHJ4*01 | 876 | gnl|Fabrus|A20__IGKJ1*01 | 1077 |
| 199 | gnl|Fabrus|VH3-23__IGHD6-13*01__IGHJ4*01 | 877 | gnl|Fabrus|A20__IGKJ1*01 | 1077 |
| 200 | gnl|Fabrus|VH3-23__IGHD7-27*01__IGHJ4*01 | 880 | gnl|Fabrus|A20__IGKJ1*01 | 1077 |
| 201 | gnl|Fabrus|VH3-23__IGHD7-27*01__IGHJ6*01 | 881 | gnl|Fabrus|A20__IGKJ1*01 | 1077 |
| 202 | gnl|Fabrus|VH1-69__IGHD1-14*01__IGHJ4*01 | 770 | gnl|Fabrus|A20__IGKJ1*01 | 1077 |
| 203 | gnl|Fabrus|VH1-69__IGHD2-2*01__IGHJ4*01 | 771 | gnl|Fabrus|A20__IGKJ1*01 | 1077 |
| 204 | gnl|Fabrus|VH1-69__IGHD2-8*01__IGHJ6*01 | 772 | gnl|Fabrus|A20__IGKJ1*01 | 1077 |
| 205 | gnl|Fabrus|VH1-69__IGHD3-16*01__IGHJ4*01 | 773 | gnl|Fabrus|A20__IGKJ1*01 | 1077 |
| 206 | gnl|Fabrus|VH1-69__IGHD3-3*01__IGHJ4*01 | 774 | gnl|Fabrus|A20__IGKJ1*01 | 1077 |
| 207 | gnl|Fabrus|VH1-69__IGHD4-17*01__IGHJ4*01 | 776 | gnl|Fabrus|A20__IGKJ1*01 | 1077 |
| 208 | gnl|Fabrus|VH1-69__IGHD5-12*01__IGHJ4*01 | 777 | gnl|Fabrus|A20__IGKJ1*01 | 1077 |
| 209 | gnl|Fabrus|VH1-69__IGHD6-19*01__IGHJ4*01 | 779 | gnl|Fabrus|A20__IGKJ1*01 | 1077 |
| 210 | gnl|Fabrus|VH1-69__IGHD7-27*01__IGHJ4*01 | 781 | gnl|Fabrus|A20__IGKJ1*01 | 1077 |
| 211 | gnl|Fabrus|VH4-34__IGHD1-7*01__IGHJ4*01 | 1017 | gnl|Fabrus|A20__IGKJ1*01 | 1077 |
| 212 | gnl|Fabrus|VH4-34__IGHD2-2*01__IGHJ4*01 | 1018 | gnl|Fabrus|A20__IGKJ1*01 | 1077 |
| 213 | gnl|Fabrus|VH4-34__IGHD3-16*01__IGHJ4*01 | 1019 | gnl|Fabrus|A20__IGKJ1*01 | 1077 |
| 214 | gnl|Fabrus|VH4-34__IGHD4-17*01__IGHJ4*01 | 1021 | gnl|Fabrus|A20__IGKJ1*01 | 1077 |
| 215 | gnl|Fabrus|VH4-34__IGHD5-12*01__IGHJ4*01 | 1022 | gnl|Fabrus|A20__IGKJ1*01 | 1077 |
| 216 | gnl|Fabrus|VH4-34__IGHD6-13*01__IGHJ4*01 | 1023 | gnl|Fabrus|A20__IGKJ1*01 | 1077 |
| 217 | gnl|Fabrus|VH4-34__IGHD6-25*01__IGHJ6*01 | 1024 | gnl|Fabrus|A20__IGKJ1*01 | 1077 |
| 218 | gnl|Fabrus|VH4-34__IGHD7-27*01__IGHJ4*01 | 1026 | gnl|Fabrus|A20__IGKJ1*01 | 1077 |
| 219 | gnl|Fabrus|VH2-26__IGHD1-20*01__IGHJ4*01 | 789 | gnl|Fabrus|A20__IGKJ1*01 | 1077 |
| 220 | gnl|Fabrus|VH2-26__IGHD2-2*01__IGHJ4*01 | 791 | gnl|Fabrus|A20__IGKJ1*01 | 1077 |
| 221 | gnl|Fabrus|VH2-26__IGHD3-10*01__IGHJ4*01 | 792 | gnl|Fabrus|A20__IGKJ1*01 | 1077 |
| 222 | gnl|Fabrus|VH2-26__IGHD4-11*01__IGHJ4*01 | 794 | gnl|Fabrus|A20__IGKJ1*01 | 1077 |
| 223 | gnl|Fabrus|VH2-26__IGHD5-18*01__IGHJ4*01 | 796 | gnl|Fabrus|A20__IGKJ1*01 | 1077 |
| 224 | gnl|Fabrus|VH2-26__IGHD6-13*01__IGHJ4*01 | 797 | gnl|Fabrus|A20__IGKJ1*01 | 1077 |
| 225 | gnl|Fabrus|VH2-26__IGHD7-27*01__IGHJ4*01 | 798 | gnl|Fabrus|A20__IGKJ1*01 | 1077 |
| 226 | gnl|Fabrus|VH5-51__IGHD1-14*01__IGHJ4*01 | 1044 | gnl|Fabrus|A20__IGKJ1*01 | 1077 |
| 227 | gnl|Fabrus|VH5-51__IGHD2-8*01__IGHJ4*01 | 1046 | gnl|Fabrus|A20__IGKJ1*01 | 1077 |
| 228 | gnl|Fabrus|VH5-51__IGHD3-3*01__IGHJ4*01 | 1048 | gnl|Fabrus|A20__IGKJ1*01 | 1077 |
| 229 | gnl|Fabrus|VH5-51__IGHD4-17*01__IGHJ4*01 | 1049 | gnl|Fabrus|A20__IGKJ1*01 | 1077 |
| 230 | gnl|Fabrus|VH5-51__IGHD5-18*01__IGHJ4*01 | 1050 | gnl|Fabrus|A20__IGKJ1*01 | 1077 |
| 231 | gnl|Fabrus|VH5-51__IGHD5-18*01__IGHJ4*01 | 1051 | gnl|Fabrus|A20__IGKJ1*01 | 1077 |
| 232 | gnl|Fabrus|VH5-51__IGHD6-25*01__IGHJ4*01 | 1052 | gnl|Fabrus|A20__IGKJ1*01 | 1077 |
| 233 | gnl|Fabrus|VH5-51__IGHD7-27*01__IGHJ4*01 | 1053 | gnl|Fabrus|A20__IGKJ1*01 | 1077 |
| 234 | gnl|Fabrus|VH6-1__IGHD1-1*01__IGHJ4*01 | 1054 | gnl|Fabrus|A20__IGKJ1*01 | 1077 |
| 235 | gnl|Fabrus|VH6-1__IGHD2-15*01__IGHJ4*01 | 1056 | gnl|Fabrus|A20__IGKJ1*01 | 1077 |
| 236 | gnl|Fabrus|VH6-1__IGHD3-3*01__IGHJ4*01 | 1059 | gnl|Fabrus|A20__IGKJ1*01 | 1077 |
| 237 | gnl|Fabrus|VH6-1__IGHD4-23*01__IGHJ4*01 | 1061 | gnl|Fabrus|A20__IGKJ1*01 | 1077 |
| 238 | gnl|Fabrus|VH6-1__IGHD4-11*01__IGHJ6*01 | 1060 | gnl|Fabrus|A20__IGKJ1*01 | 1077 |
| 239 | gnl|Fabrus|VH6-1__IGHD5-5*01__IGHJ4*01 | 1062 | gnl|Fabrus|A20__IGKJ1*01 | 1077 |

TABLE 4-continued

Exemplary Paired Nucleic Acid Library

| | HEAVY CHAIN | SEQ ID NO | LIGHT CHAIN | SEQ ID NO |
|---|---|---|---|---|
| 240 | gnl\|Fabrus\|VH6-1__IGHD6-13*01__IGHJ4*01 | 1063 | gnl\|Fabrus\|A20__IGKJ1*01 | 1077 |
| 241 | gnl\|Fabrus\|VH6-1__IGHD6-25*01__IGHJ6*01 | 1064 | gnl\|Fabrus\|A20__IGKJ1*01 | 1077 |
| 242 | gnl\|Fabrus\|VH6-1__IGHD7-27*01__IGHJ4*01 | 1065 | gnl\|Fabrus\|A20__IGKJ1*01 | 1077 |
| 243 | gnl\|Fabrus\|VH4-59__IGHD6-25*01__IGHJ3*01 | 1043 | gnl\|Fabrus\|A20__IGKJ1*01 | 1077 |
| 244 | gnl\|Fabrus\|VH3-48__IGHD6-6*01__IGHJ1*01 | 923 | gnl\|Fabrus\|A20__IGKJ1*01 | 1077 |
| 245 | gnl\|Fabrus\|VH3-30__IGHD6-6*01__IGHJ1*01 | 893 | gnl\|Fabrus\|A20__IGKJ1*01 | 1077 |
| 246 | gnl\|Fabrus\|VH3-66__IGHD6-6*01__IGHJ1*01 | 949 | gnl\|Fabrus\|A20__IGKJ1*01 | 1077 |
| 247 | gnl\|Fabrus\|VH3-53__IGHD5-5*01__IGHJ4*01 | 938 | gnl\|Fabrus\|A20__IGKJ1*01 | 1077 |
| 248 | gnl\|Fabrus\|VH2-5__IGHD5-12*01__IGHJ4*01 | 804 | gnl\|Fabrus\|A20__IGKJ1*01 | 1077 |
| 249 | gnl\|Fabrus\|VH2-70__IGHD5-12*01__IGHJ4*01 | 811 | gnl\|Fabrus\|A20__IGKJ1*01 | 1077 |
| 250 | gnl\|Fabrus\|VH3-15__IGHD5-12*01__IGHJ4*01 | 835 | gnl\|Fabrus\|A20__IGKJ1*01 | 1077 |
| 251 | gnl\|Fabrus\|VH3-15__IGHD3-10*01__IGHJ4*01 | 833 | gnl\|Fabrus\|A20__IGKJ1*01 | 1077 |
| 252 | gnl\|Fabrus\|VH3-49__IGHD5-18*01__IGHJ4*01 | 930 | gnl\|Fabrus\|A20__IGKJ1*01 | 1077 |
| 253 | gnl\|Fabrus\|VH3-49__IGHD6-13*01__IGHJ4*01 | 931 | gnl\|Fabrus\|A20__IGKJ1*01 | 1077 |
| 254 | gnl\|Fabrus\|VH3-72__IGHD5-18*01__IGHJ4*01 | 967 | gnl\|Fabrus\|A20__IGKJ1*01 | 1077 |
| 255 | gnl\|Fabrus\|VH3-72__IGHD6-6*01__IGHJ1*01 | 969 | gnl\|Fabrus\|A20__IGKJ1*01 | 1077 |
| 256 | gnl\|Fabrus\|VH3-73__IGHD5-12*01__IGHJ4*01 | 977 | gnl\|Fabrus\|A20__IGKJ1*01 | 1077 |
| 257 | gnl\|Fabrus\|VH3-73__IGHD4-23*01__IGHJ5*01 | 976 | gnl\|Fabrus\|A20__IGKJ1*01 | 1077 |
| 258 | gnl\|Fabrus\|VH3-43__IGHD3-22*01__IGHJ4*01 | 918 | gnl\|Fabrus\|A20__IGKJ1*01 | 1077 |
| 259 | gnl\|Fabrus\|VH3-43__IGHD6-13*01__IGHJ4*01 | 921 | gnl\|Fabrus\|A20__IGKJ1*01 | 1077 |
| 260 | gnl\|Fabrus\|VH3-9__IGHD3-22*01__IGHJ4*01 | 992 | gnl\|Fabrus\|A20__IGKJ1*01 | 1077 |
| 261 | gnl\|Fabrus\|VH3-9__IGHD1-7*01__IGHJ5*01 | 989 | gnl\|Fabrus\|A20__IGKJ1*01 | 1077 |
| 262 | gnl\|Fabrus\|VH3-9__IGHD6-13*01__IGHJ4*01 | 995 | gnl\|Fabrus\|A20__IGKJ1*01 | 1077 |
| 263 | gnl\|Fabrus\|VH4-39__IGHD3-10*01__IGHJ4*01 | 1030 | gnl\|Fabrus\|A20__IGKJ1*01 | 1077 |
| 264 | gnl\|Fabrus\|VH4-39__IGHD5-12*01__IGHJ4*01 | 1034 | gnl\|Fabrus\|A20__IGKJ1*01 | 1077 |
| 265 | gnl\|Fabrus\|VH1-18__IGHD6-6*01__IGHJ1*01 | 728 | gnl\|Fabrus\|A20__IGKJ1*01 | 1077 |
| 266 | gnl\|Fabrus\|VH1-24__IGHD5-12*01__IGHJ4*01 | 735 | gnl\|Fabrus\|A20__IGKJ1*01 | 1077 |
| 267 | gnl\|Fabrus\|VH1-2__IGHD1-1*01__IGHJ3*01 | 729 | gnl\|Fabrus\|A20__IGKJ1*01 | 1077 |
| 268 | gnl\|Fabrus\|VH1-3__IGHD6-6*01__IGHJ1*01 | 743 | gnl\|Fabrus\|A20__IGKJ1*01 | 1077 |
| 269 | gnl\|Fabrus\|VH1-45__IGHD3-10*01__IGHJ4*01 | 748 | gnl\|Fabrus\|A20__IGKJ1*01 | 1077 |
| 270 | gnl\|Fabrus\|VH1-46__IGHD1-26*01__IGHJ4*01 | 754 | gnl\|Fabrus\|A20__IGKJ1*01 | 1077 |
| 271 | gnl\|Fabrus\|VH7-81__IGHD2-21*01__IGHJ6*01 | 1068 | gnl\|Fabrus\|A20__IGKJ1*01 | 1077 |
| 272 | gnl\|Fabrus\|VH2-70__IGHD3-9*01__IGHJ6*01 | 810 | gnl\|Fabrus\|A20__IGKJ1*01 | 1077 |
| 273 | gnl\|Fabrus\|VH1-58__IGHD3-10*01__IGHJ6*01 | 764 | gnl\|Fabrus\|A20__IGKJ1*01 | 1077 |
| 274 | gnl\|Fabrus\|VH7-81__IGHD2-21*01__IGHJ2*01 | 1067 | gnl\|Fabrus\|A20__IGKJ1*01 | 1077 |
| 275 | gnl\|Fabrus\|VH4-28__IGHD3-9*01__IGHJ6*01 | 1002 | gnl\|Fabrus\|A20__IGKJ1*01 | 1077 |
| 276 | gnl\|Fabrus\|VH4-31__IGHD2-15*01__IGHJ2*01 | 1008 | gnl\|Fabrus\|A20__IGKJ1*01 | 1077 |
| 277 | gnl\|Fabrus\|VH2-5__IGHD3-9*01__IGHJ6*01 | 803 | gnl\|Fabrus\|A20__IGKJ1*01 | 1077 |
| 278 | gnl\|Fabrus\|VH1-8__IGHD2-15*01__IGHJ6*01 | 783 | gnl\|Fabrus\|A20__IGKJ1*01 | 1077 |
| 279 | gnl\|Fabrus\|VH2-70__IGHD2-15*01__IGHJ2*01 | 808 | gnl\|Fabrus\|A20__IGKJ1*01 | 1077 |
| 280 | gnl\|Fabrus\|VH3-38__IGHD3-10*01__IGHJ4*01 | 907 | gnl\|Fabrus\|A20__IGKJ1*01 | 1077 |
| 281 | gnl\|Fabrus\|VH3-16__IGHD1-7*01__IGHJ6*01 | 838 | gnl\|Fabrus\|A20__IGKJ1*01 | 1077 |
| 282 | gnl\|Fabrus\|VH3-73__IGHD3-9*01__IGHJ6*01 | 974 | gnl\|Fabrus\|A20__IGKJ1*01 | 1077 |
| 283 | gnl\|Fabrus\|VH3-11__IGHD3-9*01__IGHJ6*01 | 816 | gnl\|Fabrus\|A20__IGKJ1*01 | 1077 |
| 284 | gnl\|Fabrus\|VH3-11__IGHD6-6*01__IGHJ1*01 | 820 | gnl\|Fabrus\|A20__IGKJ1*01 | 1077 |
| 285 | gnl\|Fabrus\|VH3-20__IGHD5-12*01__IGHJ4*01 | 852 | gnl\|Fabrus\|A20__IGKJ1*01 | 1077 |
| 286 | gnl\|Fabrus\|VH3-16__IGHD2-15*01__IGHJ2*01 | 839 | gnl\|Fabrus\|A20__IGKJ1*01 | 1077 |
| 287 | gnl\|Fabrus\|VH3-7__IGHD6-6*01__IGHJ1*01 | 960 | gnl\|Fabrus\|A20__IGKJ1*01 | 1077 |
| 288 | gnl\|Fabrus\|VH3-16__IGHD6-13*01__IGHJ4*01 | 844 | gnl\|Fabrus\|A20__IGKJ1*01 | 1077 |
| 289 | gnl\|Fabrus\|VH3-23__IGHD1-1*01__IGHJ4*01 | 863 | gnl\|Fabrus\|A30__IGKJ1*01 | 1082 |
| 290 | gnl\|Fabrus\|VH3-23__IGHD2-15*01__IGHJ4*01 | 866 | gnl\|Fabrus\|A30__IGKJ1*01 | 1082 |
| 291 | gnl\|Fabrus\|VH3-23__IGHD3-22*01__IGHJ4*01 | 870 | gnl\|Fabrus\|A30__IGKJ1*01 | 1082 |
| 292 | gnl\|Fabrus\|VH3-23__IGHD4-11*01__IGHJ4*01 | 872 | gnl\|Fabrus\|A30__IGKJ1*01 | 1082 |
| 293 | gnl\|Fabrus\|VH3-23__IGHD5-12*01__IGHJ4*01 | 874 | gnl\|Fabrus\|A30__IGKJ1*01 | 1082 |
| 294 | gnl\|Fabrus\|VH3-23__IGHD5-5*01__IGHJ4*01 | 876 | gnl\|Fabrus\|A30__IGKJ1*01 | 1082 |
| 295 | gnl\|Fabrus\|VH3-23__IGHD6-13*01__IGHJ4*01 | 877 | gnl\|Fabrus\|A30__IGKJ1*01 | 1082 |
| 296 | gnl\|Fabrus\|VH3-23__IGHD7-27*01__IGHJ4*01 | 880 | gnl\|Fabrus\|A30__IGKJ1*01 | 1082 |
| 297 | gnl\|Fabrus\|VH3-23__IGHD7-27*01__IGHJ6*01 | 881 | gnl\|Fabrus\|A30__IGKJ1*01 | 1082 |
| 298 | gnl\|Fabrus\|VH1-69__IGHD1-14*01__IGHJ4*01 | 770 | gnl\|Fabrus\|A30__IGKJ1*01 | 1082 |
| 299 | gnl\|Fabrus\|VH1-69__IGHD2-2*01__IGHJ4*01 | 771 | gnl\|Fabrus\|A30__IGKJ1*01 | 1082 |
| 300 | gnl\|Fabrus\|VH1-69__IGHD2-8*01__IGHJ6*01 | 772 | gnl\|Fabrus\|A30__IGKJ1*01 | 1082 |
| 301 | gnl\|Fabrus\|VH1-69__IGHD3-16*01__IGHJ4*01 | 773 | gnl\|Fabrus\|A30__IGKJ1*01 | 1082 |
| 302 | gnl\|Fabrus\|VH1-69__IGHD3-3*01__IGHJ4*01 | 774 | gnl\|Fabrus\|A30__IGKJ1*01 | 1082 |
| 303 | gnl\|Fabrus\|VH1-69__IGHD4-17*01__IGHJ4*01 | 776 | gnl\|Fabrus\|A30__IGKJ1*01 | 1082 |
| 304 | gnl\|Fabrus\|VH1-69__IGHD5-12*01__IGHJ4*01 | 777 | gnl\|Fabrus\|A30__IGKJ1*01 | 1082 |
| 305 | gnl\|Fabrus\|VH1-69__IGHD6-19*01__IGHJ4*01 | 779 | gnl\|Fabrus\|A30__IGKJ1*01 | 1082 |
| 306 | gnl\|Fabrus\|VH1-69__IGHD7-27*01__IGHJ4*01 | 781 | gnl\|Fabrus\|A30__IGKJ1*01 | 1082 |
| 307 | gnl\|Fabrus\|VH4-34__IGHD1-7*01__IGHJ4*01 | 1017 | gnl\|Fabrus\|A30__IGKJ1*01 | 1082 |
| 308 | gnl\|Fabrus\|VH4-34__IGHD2-2*01__IGHJ4*01 | 1018 | gnl\|Fabrus\|A30__IGKJ1*01 | 1082 |
| 309 | gnl\|Fabrus\|VH4-34__IGHD3-16*01__IGHJ4*01 | 1019 | gnl\|Fabrus\|A30__IGKJ1*01 | 1082 |
| 310 | gnl\|Fabrus\|VH4-34__IGHD4-17*01__IGHJ4*01 | 1021 | gnl\|Fabrus\|A30__IGKJ1*01 | 1082 |
| 311 | gnl\|Fabrus\|VH4-34__IGHD5-12*01__IGHJ4*01 | 1022 | gnl\|Fabrus\|A30__IGKJ1*01 | 1082 |
| 312 | gnl\|Fabrus\|VH4-34__IGHD6-13*01__IGHJ4*01 | 1023 | gnl\|Fabrus\|A30__IGKJ1*01 | 1082 |
| 313 | gnl\|Fabrus\|VH4-34__IGHD6-25*01__IGHJ6*01 | 1024 | gnl\|Fabrus\|A30__IGKJ1*01 | 1082 |

TABLE 4-continued

Exemplary Paired Nucleic Acid Library

| | HEAVY CHAIN | SEQ ID NO | LIGHT CHAIN | SEQ ID NO |
|---|---|---|---|---|
| 314 | gnl\|Fabrus\|VH4-34__IGHD7-27*01__IGHJ4*01 | 1026 | gnl\|Fabrus\|A30__IGKJ1*01 | 1082 |
| 315 | gnl\|Fabrus\|VH2-26__IGHD1-20*01__IGHJ4*01 | 789 | gnl\|Fabrus\|A30__IGKJ1*01 | 1082 |
| 316 | gnl\|Fabrus\|VH2-26__IGHD2-2*01__IGHJ4*01 | 791 | gnl\|Fabrus\|A30__IGKJ1*01 | 1082 |
| 317 | gnl\|Fabrus\|VH2-26__IGHD3-10*01__IGHJ4*01 | 792 | gnl\|Fabrus\|A30__IGKJ1*01 | 1082 |
| 318 | gnl\|Fabrus\|VH2-26__IGHD4-11*01__IGHJ4*01 | 794 | gnl\|Fabrus\|A30__IGKJ1*01 | 1082 |
| 319 | gnl\|Fabrus\|VH2-26__IGHD5-18*01__IGHJ4*01 | 796 | gnl\|Fabrus\|A30__IGKJ1*01 | 1082 |
| 320 | gnl\|Fabrus\|VH2-26__IGHD6-13*01__IGHJ4*01 | 797 | gnl\|Fabrus\|A30__IGKJ1*01 | 1082 |
| 321 | gnl\|Fabrus\|VH2-26__IGHD7-27*01__IGHJ4*01 | 798 | gnl\|Fabrus\|A30__IGKJ1*01 | 1082 |
| 322 | gnl\|Fabrus\|VH5-51__IGHD1-14*01__IGHJ4*01 | 1044 | gnl\|Fabrus\|A30__IGKJ1*01 | 1082 |
| 323 | gnl\|Fabrus\|VH5-51__IGHD2-8*01__IGHJ4*01 | 1046 | gnl\|Fabrus\|A30__IGKJ1*01 | 1082 |
| 324 | gnl\|Fabrus\|VH5-51__IGHD3-3*01__IGHJ4*01 | 1048 | gnl\|Fabrus\|A30__IGKJ1*01 | 1082 |
| 325 | gnl\|Fabrus\|VH5-51__IGHD4-17*01__IGHJ4*01 | 1049 | gnl\|Fabrus\|A30__IGKJ1*01 | 1082 |
| 326 | gnl\|Fabrus\|VH5-51__IGHD5-18*01__IGHJ4*01 | 1050 | gnl\|Fabrus\|A30__IGKJ1*01 | 1082 |
| 327 | gnl\|Fabrus\|VH5-51__IGHD5-18*01__IGHJ4*01 | 1051 | gnl\|Fabrus\|A30__IGKJ1*01 | 1082 |
| 328 | gnl\|Fabrus\|VH5-51__IGHD6-25*01__IGHJ4*01 | 1052 | gnl\|Fabrus\|A30__IGKJ1*01 | 1082 |
| 329 | gnl\|Fabrus\|VH5-51__IGHD7-27*01__IGHJ4*01 | 1053 | gnl\|Fabrus\|A30__IGKJ1*01 | 1082 |
| 330 | gnl\|Fabrus\|VH6-1__IGHD1-1*01__IGHJ4*01 | 1054 | gnl\|Fabrus\|A30__IGKJ1*01 | 1082 |
| 331 | gnl\|Fabrus\|VH6-1__IGHD2-15*01__IGHJ4*01 | 1056 | gnl\|Fabrus\|A30__IGKJ1*01 | 1082 |
| 332 | gnl\|Fabrus\|VH6-1__IGHD3-3*01__IGHJ4*01 | 1059 | gnl\|Fabrus\|A30__IGKJ1*01 | 1082 |
| 333 | gnl\|Fabrus\|VH6-1__IGHD4-23*01__IGHJ4*01 | 1061 | gnl\|Fabrus\|A30__IGKJ1*01 | 1082 |
| 334 | gnl\|Fabrus\|VH6-1__IGHD4-11*01__IGHJ6*01 | 1060 | gnl\|Fabrus\|A30__IGKJ1*01 | 1082 |
| 335 | gnl\|Fabrus\|VH6-1__IGHD5-5*01__IGHJ4*01 | 1062 | gnl\|Fabrus\|A30__IGKJ1*01 | 1082 |
| 336 | gnl\|Fabrus\|VH6-1__IGHD6-13*01__IGHJ4*01 | 1063 | gnl\|Fabrus\|A30__IGKJ1*01 | 1082 |
| 337 | gnl\|Fabrus\|VH6-1__IGHD6-25*01__IGHJ6*01 | 1064 | gnl\|Fabrus\|A30__IGKJ1*01 | 1082 |
| 338 | gnl\|Fabrus\|VH6-1__IGHD7-27*01__IGHJ4*01 | 1065 | gnl\|Fabrus\|A30__IGKJ1*01 | 1082 |
| 339 | gnl\|Fabrus\|VH4-59__IGHD6-25*01__IGHJ3*01 | 1043 | gnl\|Fabrus\|A30__IGKJ1*01 | 1082 |
| 340 | gnl\|Fabrus\|VH3-48__IGHD6-6*01__IGHJ1*01 | 923 | gnl\|Fabrus\|A30__IGKJ1*01 | 1082 |
| 341 | gnl\|Fabrus\|VH3-30__IGHD6-6*01__IGHJ1*01 | 893 | gnl\|Fabrus\|A30__IGKJ1*01 | 1082 |
| 342 | gnl\|Fabrus\|VH3-66__IGHD6-6*01__IGHJ1*01 | 949 | gnl\|Fabrus\|A30__IGKJ1*01 | 1082 |
| 343 | gnl\|Fabrus\|VH3-53__IGHD5-5*01__IGHJ4*01 | 938 | gnl\|Fabrus\|A30__IGKJ1*01 | 1082 |
| 344 | gnl\|Fabrus\|VH2-5__IGHD5-12*01__IGHJ4*01 | 804 | gnl\|Fabrus\|A30__IGKJ1*01 | 1082 |
| 345 | gnl\|Fabrus\|VH2-70__IGHD5-12*01__IGHJ4*01 | 811 | gnl\|Fabrus\|A30__IGKJ1*01 | 1082 |
| 346 | gnl\|Fabrus\|VH3-15__IGHD5-12*01__IGHJ4*01 | 835 | gnl\|Fabrus\|A30__IGKJ1*01 | 1082 |
| 347 | gnl\|Fabrus\|VH3-15__IGHD3-10*01__IGHJ4*01 | 833 | gnl\|Fabrus\|A30__IGKJ1*01 | 1082 |
| 348 | gnl\|Fabrus\|VH3-49__IGHD5-18*01__IGHJ4*01 | 930 | gnl\|Fabrus\|A30__IGKJ1*01 | 1082 |
| 349 | gnl\|Fabrus\|VH3-49__IGHD6-13*01__IGHJ4*01 | 931 | gnl\|Fabrus\|A30__IGKJ1*01 | 1082 |
| 350 | gnl\|Fabrus\|VH3-72__IGHD5-18*01__IGHJ4*01 | 967 | gnl\|Fabrus\|A30__IGKJ1*01 | 1082 |
| 351 | gnl\|Fabrus\|VH3-72__IGHD6-6*01__IGHJ1*01 | 969 | gnl\|Fabrus\|A30__IGKJ1*01 | 1082 |
| 352 | gnl\|Fabrus\|VH3-73__IGHD5-12*01__IGHJ4*01 | 977 | gnl\|Fabrus\|A30__IGKJ1*01 | 1082 |
| 353 | gnl\|Fabrus\|VH3-73__IGHD4-23*01__IGHJ5*01 | 976 | gnl\|Fabrus\|A30__IGKJ1*01 | 1082 |
| 354 | gnl\|Fabrus\|VH3-43__IGHD3-22*01__IGHJ4*01 | 918 | gnl\|Fabrus\|A30__IGKJ1*01 | 1082 |
| 355 | gnl\|Fabrus\|VH3-43__IGHD6-13*01__IGHJ4*01 | 921 | gnl\|Fabrus\|A30__IGKJ1*01 | 1082 |
| 356 | gnl\|Fabrus\|VH3-9__IGHD3-22*01__IGHJ4*01 | 992 | gnl\|Fabrus\|A30__IGKJ1*01 | 1082 |
| 357 | gnl\|Fabrus\|VH3-9__IGHD1-7*01__IGHJ5*01 | 989 | gnl\|Fabrus\|A30__IGKJ1*01 | 1082 |
| 358 | gnl\|Fabrus\|VH3-9__IGHD6-13*01__IGHJ4*01 | 995 | gnl\|Fabrus\|A30__IGKJ1*01 | 1082 |
| 359 | gnl\|Fabrus\|VH4-39__IGHD3-10*01__IGHJ4*01 | 1030 | gnl\|Fabrus\|A30__IGKJ1*01 | 1082 |
| 360 | gnl\|Fabrus\|VH4-39__IGHD5-12*01__IGHJ4*01 | 1034 | gnl\|Fabrus\|A30__IGKJ1*01 | 1082 |
| 361 | gnl\|Fabrus\|VH1-18__IGHD6-6*01__IGHJ1*01 | 728 | gnl\|Fabrus\|A30__IGKJ1*01 | 1082 |
| 362 | gnl\|Fabrus\|VH1-24__IGHD5-12*01__IGHJ4*01 | 735 | gnl\|Fabrus\|A30__IGKJ1*01 | 1082 |
| 363 | gnl\|Fabrus\|VH1-2__IGHD1-1*01__IGHJ3*01 | 729 | gnl\|Fabrus\|A30__IGKJ1*01 | 1082 |
| 364 | gnl\|Fabrus\|VH1-3__IGHD6-6*01__IGHJ1*01 | 743 | gnl\|Fabrus\|A30__IGKJ1*01 | 1082 |
| 365 | gnl\|Fabrus\|VH1-45__IGHD3-10*01__IGHJ4*01 | 748 | gnl\|Fabrus\|A30__IGKJ1*01 | 1082 |
| 366 | gnl\|Fabrus\|VH1-46__IGHD1-26*01__IGHJ4*01 | 754 | gnl\|Fabrus\|A30__IGKJ1*01 | 1082 |
| 367 | gnl\|Fabrus\|VH7-81__IGHD2-21*01__IGHJ6*01 | 1068 | gnl\|Fabrus\|A30__IGKJ1*01 | 1082 |
| 368 | gnl\|Fabrus\|VH2-70__IGHD3-9*01__IGHJ6*01 | 810 | gnl\|Fabrus\|A30__IGKJ1*01 | 1082 |
| 369 | gnl\|Fabrus\|VH1-58__IGHD3-10*01__IGHJ6*01 | 764 | gnl\|Fabrus\|A30__IGKJ1*01 | 1082 |
| 370 | gnl\|Fabrus\|VH7-81__IGHD2-21*01__IGHJ2*01 | 1067 | gnl\|Fabrus\|A30__IGKJ1*01 | 1082 |
| 371 | gnl\|Fabrus\|VH4-28__IGHD3-9*01__IGHJ6*01 | 1002 | gnl\|Fabrus\|A30__IGKJ1*01 | 1082 |
| 372 | gnl\|Fabrus\|VH4-31__IGHD2-15*01__IGHJ2*01 | 1008 | gnl\|Fabrus\|A30__IGKJ1*01 | 1082 |
| 373 | gnl\|Fabrus\|VH2-5__IGHD3-9*01__IGHJ6*01 | 803 | gnl\|Fabrus\|A30__IGKJ1*01 | 1082 |
| 374 | gnl\|Fabrus\|VH1-8__IGHD2-15*01__IGHJ6*01 | 783 | gnl\|Fabrus\|A30__IGKJ1*01 | 1082 |
| 375 | gnl\|Fabrus\|VH2-70__IGHD2-15*01__IGHJ2*01 | 808 | gnl\|Fabrus\|A30__IGKJ1*01 | 1082 |
| 376 | gnl\|Fabrus\|VH3-38__IGHD3-10*01__IGHJ4*01 | 907 | gnl\|Fabrus\|A30__IGKJ1*01 | 1082 |
| 377 | gnl\|Fabrus\|VH3-16__IGHD1-7*01__IGHJ6*01 | 838 | gnl\|Fabrus\|A30__IGKJ1*01 | 1082 |
| 378 | gnl\|Fabrus\|VH3-73__IGHD3-9*01__IGHJ6*01 | 974 | gnl\|Fabrus\|A30__IGKJ1*01 | 1082 |
| 379 | gnl\|Fabrus\|VH3-11__IGHD3-9*01__IGHJ6*01 | 816 | gnl\|Fabrus\|A30__IGKJ1*01 | 1082 |
| 380 | gnl\|Fabrus\|VH3-11__IGHD6-6*01__IGHJ1*01 | 820 | gnl\|Fabrus\|A30__IGKJ1*01 | 1082 |
| 381 | gnl\|Fabrus\|VH3-20__IGHD5-12*01__IGHJ4*01 | 852 | gnl\|Fabrus\|A30__IGKJ1*01 | 1082 |
| 382 | gnl\|Fabrus\|VH3-16__IGHD2-15*01__IGHJ2*01 | 839 | gnl\|Fabrus\|A30__IGKJ1*01 | 1082 |
| 383 | gnl\|Fabrus\|VH3-7__IGHD6-6*01__IGHJ1*01 | 960 | gnl\|Fabrus\|A30__IGKJ1*01 | 1082 |
| 384 | gnl\|Fabrus\|VH3-16__IGHD6-13*01__IGHJ4*01 | 844 | gnl\|Fabrus\|A30__IGKJ1*01 | 1082 |
| 385 | gnl\|Fabrus\|VH3-23__IGHD1-1*01__IGHJ4*01 | 863 | gnl\|Fabrus\|L4/18a__IGKJ1*01 | 1095 |
| 386 | gnl\|Fabrus\|VH3-23__IGHD2-15*01__IGHJ4*01 | 866 | gnl\|Fabrus\|L4/18a__IGKJ1*01 | 1095 |
| 387 | gnl\|Fabrus\|VH3-23__IGHD3-22*01__IGHJ4*01 | 870 | gnl\|Fabrus\|L4/18a__IGKJ1*01 | 1095 |

TABLE 4-continued

Exemplary Paired Nucleic Acid Library

| | HEAVY CHAIN | SEQ ID NO | LIGHT CHAIN | SEQ ID NO |
|---|---|---|---|---|
| 388 | gnl\|Fabrus\|VH3-23__IGHD4-11*01__IGHJ4*01 | 872 | gnl\|Fabrus\|L4/18a__IGKJ1*01 | 1095 |
| 389 | gnl\|Fabrus\|VH3-23__IGHD5-12*01__IGHJ4*01 | 874 | gnl\|Fabrus\|L4/18a__IGKJ1*01 | 1095 |
| 390 | gnl\|Fabrus\|VH3-23__IGHD5-5*01__IGHJ4*01 | 876 | gnl\|Fabrus\|L4/18a__IGKJ1*01 | 1095 |
| 391 | gnl\|Fabrus\|VH3-23__IGHD6-13*01__IGHJ4*01 | 877 | gnl\|Fabrus\|L4/18a__IGKJ1*01 | 1095 |
| 392 | gnl\|Fabrus\|VH3-23__IGHD7-27*01__IGHJ4*01 | 880 | gnl\|Fabrus\|L4/18a__IGKJ1*01 | 1095 |
| 393 | gnl\|Fabrus\|VH3-23__IGHD7-27*01__IGHJ6*01 | 881 | gnl\|Fabrus\|L4/18a__IGKJ1*01 | 1095 |
| 394 | gnl\|Fabrus\|VH1-69__IGHD1-14*01__IGHJ4*01 | 770 | gnl\|Fabrus\|L4/18a__IGKJ1*01 | 1095 |
| 395 | gnl\|Fabrus\|VH1-69__IGHD2-2*01__IGHJ4*01 | 771 | gnl\|Fabrus\|L4/18a__IGKJ1*01 | 1095 |
| 396 | gnl\|Fabrus\|VH1-69__IGHD2-8*01__IGHJ6*01 | 772 | gnl\|Fabrus\|L4/18a__IGKJ1*01 | 1095 |
| 397 | gnl\|Fabrus\|VH1-69__IGHD3-16*01__IGHJ4*01 | 773 | gnl\|Fabrus\|L4/18a__IGKJ1*01 | 1095 |
| 398 | gnl\|Fabrus\|VH1-69__IGHD3-3*01__IGHJ4*01 | 774 | gnl\|Fabrus\|L4/18a__IGKJ1*01 | 1095 |
| 399 | gnl\|Fabrus\|VH1-69__IGHD4-17*01__IGHJ4*01 | 776 | gnl\|Fabrus\|L4/18a__IGKJ1*01 | 1095 |
| 400 | gnl\|Fabrus\|VH1-69__IGHD5-12*01__IGHJ4*01 | 777 | gnl\|Fabrus\|L4/18a__IGKJ1*01 | 1095 |
| 401 | gnl\|Fabrus\|VH1-69__IGHD6-19*01__IGHJ4*01 | 779 | gnl\|Fabrus\|L4/18a__IGKJ1*01 | 1095 |
| 402 | gnl\|Fabrus\|VH1-69__IGHD7-27*01__IGHJ4*01 | 781 | gnl\|Fabrus\|L4/18a__IGKJ1*01 | 1095 |
| 403 | gnl\|Fabrus\|VH4-34__IGHD1-7*01__IGHJ4*01 | 1017 | gnl\|Fabrus\|L4/18a__IGKJ1*01 | 1095 |
| 404 | gnl\|Fabrus\|VH4-34__IGHD2-2*01__IGHJ4*01 | 1018 | gnl\|Fabrus\|L4/18a__IGKJ1*01 | 1095 |
| 405 | gnl\|Fabrus\|VH4-34__IGHD3-16*01__IGHJ4*01 | 1019 | gnl\|Fabrus\|L4/18a__IGKJ1*01 | 1095 |
| 406 | gnl\|Fabrus\|VH4-34__IGHD4-17*01__IGHJ4*01 | 1021 | gnl\|Fabrus\|L4/18a__IGKJ1*01 | 1095 |
| 407 | gnl\|Fabrus\|VH4-34__IGHD5-12*01__IGHJ4*01 | 1022 | gnl\|Fabrus\|L4/18a__IGKJ1*01 | 1095 |
| 408 | gnl\|Fabrus\|VH4-34__IGHD6-13*01__IGHJ4*01 | 1023 | gnl\|Fabrus\|L4/18a__IGKJ1*01 | 1095 |
| 409 | gnl\|Fabrus\|VH4-34__IGHD6-25*01__IGHJ6*01 | 1024 | gnl\|Fabrus\|L4/18a__IGKJ1*01 | 1095 |
| 410 | gnl\|Fabrus\|VH4-34__IGHD7-27*01__IGHJ4*01 | 1026 | gnl\|Fabrus\|L4/18a__IGKJ1*01 | 1095 |
| 411 | gnl\|Fabrus\|VH2-26__IGHD1-20*01__IGHJ4*01 | 789 | gnl\|Fabrus\|L4/18a__IGKJ1*01 | 1095 |
| 412 | gnl\|Fabrus\|VH2-26__IGHD2-2*01__IGHJ4*01 | 791 | gnl\|Fabrus\|L4/18a__IGKJ1*01 | 1095 |
| 413 | gnl\|Fabrus\|VH2-26__IGHD3-10*01__IGHJ4*01 | 792 | gnl\|Fabrus\|L4/18a__IGKJ1*01 | 1095 |
| 414 | gnl\|Fabrus\|VH2-26__IGHD4-11*01__IGHJ4*01 | 794 | gnl\|Fabrus\|L4/18a__IGKJ1*01 | 1095 |
| 415 | gnl\|Fabrus\|VH2-26__IGHD5-18*01__IGHJ4*01 | 796 | gnl\|Fabrus\|L4/18a__IGKJ1*01 | 1095 |
| 416 | gnl\|Fabrus\|VH2-26__IGHD6-13*01__IGHJ4*01 | 797 | gnl\|Fabrus\|L4/18a__IGKJ1*01 | 1095 |
| 417 | gnl\|Fabrus\|VH2-26__IGHD7-27*01__IGHJ4*01 | 798 | gnl\|Fabrus\|L4/18a__IGKJ1*01 | 1095 |
| 418 | gnl\|Fabrus\|VH5-51__IGHD1-14*01__IGHJ4*01 | 1044 | gnl\|Fabrus\|L4/18a__IGKJ1*01 | 1095 |
| 419 | gnl\|Fabrus\|VH5-51__IGHD2-8*01__IGHJ4*01 | 1046 | gnl\|Fabrus\|L4/18a__IGKJ1*01 | 1095 |
| 420 | gnl\|Fabrus\|VH5-51__IGHD3-3*01__IGHJ4*01 | 1048 | gnl\|Fabrus\|L4/18a__IGKJ1*01 | 1095 |
| 421 | gnl\|Fabrus\|VH5-51__IGHD4-17*01__IGHJ4*01 | 1049 | gnl\|Fabrus\|L4/18a__IGKJ1*01 | 1095 |
| 422 | gnl\|Fabrus\|VH5-51__IGHD5-18*01__IGHJ4*01 | 1050 | gnl\|Fabrus\|L4/18a__IGKJ1*01 | 1095 |
| 423 | gnl\|Fabrus\|VH5-51__IGHD5-18*01__IGHJ4*01 | 1051 | gnl\|Fabrus\|L4/18a__IGKJ1*01 | 1095 |
| 424 | gnl\|Fabrus\|VH5-51__IGHD6-25*01__IGHJ4*01 | 1052 | gnl\|Fabrus\|L4/18a__IGKJ1*01 | 1095 |
| 425 | gnl\|Fabrus\|VH5-51__IGHD7-27*01__IGHJ4*01 | 1053 | gnl\|Fabrus\|L4/18a__IGKJ1*01 | 1095 |
| 426 | gnl\|Fabrus\|VH6-1__IGHD1-1*01__IGHJ4*01 | 1054 | gnl\|Fabrus\|L4/18a__IGKJ1*01 | 1095 |
| 427 | gnl\|Fabrus\|VH6-1__IGHD2-15*01__IGHJ4*01 | 1056 | gnl\|Fabrus\|L4/18a__IGKJ1*01 | 1095 |
| 428 | gnl\|Fabrus\|VH6-1__IGHD3-3*01__IGHJ4*01 | 1059 | gnl\|Fabrus\|L4/18a__IGKJ1*01 | 1095 |
| 429 | gnl\|Fabrus\|VH6-1__IGHD4-23*01__IGHJ4*01 | 1061 | gnl\|Fabrus\|L4/18a__IGKJ1*01 | 1095 |
| 430 | gnl\|Fabrus\|VH6-1__IGHD4-11*01__IGHJ6*01 | 1060 | gnl\|Fabrus\|L4/18a__IGKJ1*01 | 1095 |
| 431 | gnl\|Fabrus\|VH6-1__IGHD5-5*01__IGHJ4*01 | 1062 | gnl\|Fabrus\|L4/18a__IGKJ1*01 | 1095 |
| 432 | gnl\|Fabrus\|VH6-1__IGHD6-13*01__IGHJ4*01 | 1063 | gnl\|Fabrus\|L4/18a__IGKJ1*01 | 1095 |
| 433 | gnl\|Fabrus\|VH6-1__IGHD6-25*01__IGHJ6*01 | 1064 | gnl\|Fabrus\|L4/18a__IGKJ1*01 | 1095 |
| 434 | gnl\|Fabrus\|VH6-1__IGHD7-27*01__IGHJ4*01 | 1065 | gnl\|Fabrus\|L4/18a__IGKJ1*01 | 1095 |
| 435 | gnl\|Fabrus\|VH4-59__IGHD6-25*01__IGHJ3*01 | 1043 | gnl\|Fabrus\|L4/18a__IGKJ1*01 | 1095 |
| 436 | gnl\|Fabrus\|VH3-48__IGHD6-6*01__IGHJ1*01 | 923 | gnl\|Fabrus\|L4/18a__IGKJ1*01 | 1095 |
| 437 | gnl\|Fabrus\|VH3-30__IGHD6-6*01__IGHJ1*01 | 893 | gnl\|Fabrus\|L4/18a__IGKJ1*01 | 1095 |
| 438 | gnl\|Fabrus\|VH3-66__IGHD6-6*01__IGHJ1*01 | 949 | gnl\|Fabrus\|L4/18a__IGKJ1*01 | 1095 |
| 439 | gnl\|Fabrus\|VH3-53__IGHD5-5*01__IGHJ4*01 | 938 | gnl\|Fabrus\|L4/18a__IGKJ1*01 | 1095 |
| 440 | gnl\|Fabrus\|VH2-5__IGHD5-12*01__IGHJ4*01 | 804 | gnl\|Fabrus\|L4/18a__IGKJ1*01 | 1095 |
| 441 | gnl\|Fabrus\|VH2-70__IGHD5-12*01__IGHJ4*01 | 811 | gnl\|Fabrus\|L4/18a__IGKJ1*01 | 1095 |
| 442 | gnl\|Fabrus\|VH3-15__IGHD5-12*01__IGHJ4*01 | 835 | gnl\|Fabrus\|L4/18a__IGKJ1*01 | 1095 |
| 443 | gnl\|Fabrus\|VH3-15__IGHD3-10*01__IGHJ4*01 | 833 | gnl\|Fabrus\|L4/18a__IGKJ1*01 | 1095 |
| 444 | gnl\|Fabrus\|VH3-49__IGHD5-18*01__IGHJ4*01 | 930 | gnl\|Fabrus\|L4/18a__IGKJ1*01 | 1095 |
| 445 | gnl\|Fabrus\|VH3-49__IGHD6-13*01__IGHJ4*01 | 931 | gnl\|Fabrus\|L4/18a__IGKJ1*01 | 1095 |
| 446 | gnl\|Fabrus\|VH3-72__IGHD5-18*01__IGHJ4*01 | 967 | gnl\|Fabrus\|L4/18a__IGKJ1*01 | 1095 |
| 447 | gnl\|Fabrus\|VH3-72__IGHD6-6*01__IGHJ1*01 | 969 | gnl\|Fabrus\|L4/18a__IGKJ1*01 | 1095 |
| 448 | gnl\|Fabrus\|VH3-73__IGHD5-12*01__IGHJ4*01 | 977 | gnl\|Fabrus\|L4/18a__IGKJ1*01 | 1095 |
| 449 | gnl\|Fabrus\|VH3-73__IGHD4-23*01__IGHJ5*01 | 976 | gnl\|Fabrus\|L4/18a__IGKJ1*01 | 1095 |
| 450 | gnl\|Fabrus\|VH3-43__IGHD3-22*01__IGHJ4*01 | 918 | gnl\|Fabrus\|L4/18a__IGKJ1*01 | 1095 |
| 451 | gnl\|Fabrus\|VH3-43__IGHD6-13*01__IGHJ4*01 | 921 | gnl\|Fabrus\|L4/18a__IGKJ1*01 | 1095 |
| 452 | gnl\|Fabrus\|VH3-9__IGHD3-22*01__IGHJ4*01 | 992 | gnl\|Fabrus\|L4/18a__IGKJ1*01 | 1095 |
| 453 | gnl\|Fabrus\|VH3-9__IGHD1-7*01__IGHJ5*01 | 989 | gnl\|Fabrus\|L4/18a__IGKJ1*01 | 1095 |
| 454 | gnl\|Fabrus\|VH3-9__IGHD6-13*01__IGHJ4*01 | 995 | gnl\|Fabrus\|L4/18a__IGKJ1*01 | 1095 |
| 455 | gnl\|Fabrus\|VH4-39__IGHD3-10*01__IGHJ4*01 | 1030 | gnl\|Fabrus\|L4/18a__IGKJ1*01 | 1095 |
| 456 | gnl\|Fabrus\|VH4-39__IGHD5-12*01__IGHJ4*01 | 1034 | gnl\|Fabrus\|L4/18a__IGKJ1*01 | 1095 |
| 457 | gnl\|Fabrus\|VH1-18__IGHD6-6*01__IGHJ1*01 | 728 | gnl\|Fabrus\|L4/18a__IGKJ1*01 | 1095 |
| 458 | gnl\|Fabrus\|VH1-24__IGHD5-12*01__IGHJ4*01 | 735 | gnl\|Fabrus\|L4/18a__IGKJ1*01 | 1095 |
| 459 | gnl\|Fabrus\|VH1-2__IGHD1-1*01__IGHJ3*01 | 729 | gnl\|Fabrus\|L4/18a__IGKJ1*01 | 1095 |
| 460 | gnl\|Fabrus\|VH1-3__IGHD6-6*01__IGHJ1*01 | 743 | gnl\|Fabrus\|L4/18a__IGKJ1*01 | 1095 |
| 461 | gnl\|Fabrus\|VH1-45__IGHD3-10*01__IGHJ4*01 | 748 | gnl\|Fabrus\|L4/18a__IGKJ1*01 | 1095 |

TABLE 4-continued

Exemplary Paired Nucleic Acid Library

| | HEAVY CHAIN | SEQ ID NO | LIGHT CHAIN | SEQ ID NO |
|---|---|---|---|---|
| 462 | gnl|Fabrus|VH1-46__IGHD1-26*01__IGHJ4*01 | 754 | gnl|Fabrus|L4/18a__IGKJ1*01 | 1095 |
| 463 | gnl|Fabrus|VH7-81__IGHD2-21*01__IGHJ6*01 | 1068 | gnl|Fabrus|L4/18a__IGKJ1*01 | 1095 |
| 464 | gnl|Fabrus|VH2-70__IGHD3-9*01__IGHJ6*01 | 810 | gnl|Fabrus|L4/18a__IGKJ1*01 | 1095 |
| 465 | gnl|Fabrus|VH1-58__IGHD3-10*01__IGHJ6*01 | 764 | gnl|Fabrus|L4/18a__IGKJ1*01 | 1095 |
| 466 | gnl|Fabrus|VH7-81__IGHD2-21*01__IGHJ2*01 | 1067 | gnl|Fabrus|L4/18a__IGKJ1*01 | 1095 |
| 467 | gnl|Fabrus|VH4-28__IGHD3-9*01__IGHJ6*01 | 1002 | gnl|Fabrus|L4/18a__IGKJ1*01 | 1095 |
| 468 | gnl|Fabrus|VH4-31__IGHD2-15*01__IGHJ2*01 | 1008 | gnl|Fabrus|L4/18a__IGKJ1*01 | 1095 |
| 469 | gnl|Fabrus|VH2-5__IGHD3-9*01__IGHJ6*01 | 803 | gnl|Fabrus|L4/18a__IGKJ1*01 | 1095 |
| 470 | gnl|Fabrus|VH1-8__IGHD2-15*01__IGHJ6*01 | 783 | gnl|Fabrus|L4/18a__IGKJ1*01 | 1095 |
| 471 | gnl|Fabrus|VH2-70__IGHD2-15*01__IGHJ2*01 | 808 | gnl|Fabrus|L4/18a__IGKJ1*01 | 1095 |
| 472 | gnl|Fabrus|VH3-38__IGHD3-10*01__IGHJ4*01 | 907 | gnl|Fabrus|L4/18a__IGKJ1*01 | 1095 |
| 473 | gnl|Fabrus|VH3-16__IGHD1-7*01__IGHJ6*01 | 838 | gnl|Fabrus|L4/18a__IGKJ1*01 | 1095 |
| 474 | gnl|Fabrus|VH3-73__IGHD3-9*01__IGHJ6*01 | 974 | gnl|Fabrus|L4/18a__IGKJ1*01 | 1095 |
| 475 | gnl|Fabrus|VH3-11__IGHD3-9*01__IGHJ6*01 | 816 | gnl|Fabrus|L4/18a__IGKJ1*01 | 1095 |
| 476 | gnl|Fabrus|VH3-11__IGHD6-6*01__IGHJ1*01 | 820 | gnl|Fabrus|L4/18a__IGKJ1*01 | 1095 |
| 477 | gnl|Fabrus|VH3-20__IGHD5-12*01__IGHJ4*01 | 852 | gnl|Fabrus|L4/18a__IGKJ1*01 | 1095 |
| 478 | gnl|Fabrus|VH3-16__IGHD2-15*01__IGHJ2*01 | 839 | gnl|Fabrus|L4/18a__IGKJ1*01 | 1095 |
| 479 | gnl|Fabrus|VH3-7__IGHD6-6*01__IGHJ1*01 | 960 | gnl|Fabrus|L4/18a__IGKJ1*01 | 1095 |
| 480 | gnl|Fabrus|VH3-16__IGHD6-13*01__IGHJ4*01 | 844 | gnl|Fabrus|L4/18a__IGKJ1*01 | 1095 |
| 481 | gnl|Fabrus|VH3-23__IGHD1-1*01__IGHJ4*01 | 863 | gnl|Fabrus|L5__IGKJ1*01 | 1096 |
| 482 | gnl|Fabrus|VH3-23__IGHD2-15*01__IGHJ4*01 | 866 | gnl|Fabrus|L5__IGKJ1*01 | 1096 |
| 483 | gnl|Fabrus|VH3-23__IGHD3-22*01__IGHJ4*01 | 870 | gnl|Fabrus|L5__IGKJ1*01 | 1096 |
| 484 | gnl|Fabrus|VH3-23__IGHD4-11*01__IGHJ4*01 | 872 | gnl|Fabrus|L5__IGKJ1*01 | 1096 |
| 485 | gnl|Fabrus|VH3-23__IGHD5-12*01__IGHJ4*01 | 874 | gnl|Fabrus|L5__IGKJ1*01 | 1096 |
| 486 | gnl|Fabrus|VH3-23__IGHD5-5*01__IGHJ4*01 | 876 | gnl|Fabrus|L5__IGKJ1*01 | 1096 |
| 487 | gnl|Fabrus|VH3-23__IGHD6-13*01__IGHJ4*01 | 877 | gnl|Fabrus|L5__IGKJ1*01 | 1096 |
| 488 | gnl|Fabrus|VH3-23__IGHD7-27*01__IGHJ4*01 | 880 | gnl|Fabrus|L5__IGKJ1*01 | 1096 |
| 489 | gnl|Fabrus|VH3-23__IGHD7-27*01__IGHJ6*01 | 881 | gnl|Fabrus|L5__IGKJ1*01 | 1096 |
| 490 | gnl|Fabrus|VH1-69__IGHD1-14*01__IGHJ4*01 | 770 | gnl|Fabrus|L5__IGKJ1*01 | 1096 |
| 491 | gnl|Fabrus|VH1-69__IGHD2-2*01__IGHJ4*01 | 771 | gnl|Fabrus|L5__IGKJ1*01 | 1096 |
| 492 | gnl|Fabrus|VH1-69__IGHD2-8*01__IGHJ6*01 | 772 | gnl|Fabrus|L5__IGKJ1*01 | 1096 |
| 493 | gnl|Fabrus|VH1-69__IGHD3-16*01__IGHJ4*01 | 773 | gnl|Fabrus|L5__IGKJ1*01 | 1096 |
| 494 | gnl|Fabrus|VH1-69__IGHD3-3*01__IGHJ4*01 | 774 | gnl|Fabrus|L5__IGKJ1*01 | 1096 |
| 495 | gnl|Fabrus|VH1-69__IGHD4-17*01__IGHJ4*01 | 776 | gnl|Fabrus|L5__IGKJ1*01 | 1096 |
| 496 | gnl|Fabrus|VH1-69__IGHD5-12*01__IGHJ4*01 | 777 | gnl|Fabrus|L5__IGKJ1*01 | 1096 |
| 497 | gnl|Fabrus|VH1-69__IGHD6-19*01__IGHJ4*01 | 779 | gnl|Fabrus|L5__IGKJ1*01 | 1096 |
| 498 | gnl|Fabrus|VH1-69__IGHD7-27*01__IGHJ4*01 | 781 | gnl|Fabrus|L5__IGKJ1*01 | 1096 |
| 499 | gnl|Fabrus|VH4-34__IGHD1-7*01__IGHJ4*01 | 1017 | gnl|Fabrus|L5__IGKJ1*01 | 1096 |
| 500 | gnl|Fabrus|VH4-34__IGHD2-2*01__IGHJ4*01 | 1018 | gnl|Fabrus|L5__IGKJ1*01 | 1096 |
| 501 | gnl|Fabrus|VH4-34__IGHD3-16*01__IGHJ4*01 | 1019 | gnl|Fabrus|L5__IGKJ1*01 | 1096 |
| 502 | gnl|Fabrus|VH4-34__IGHD4-17*01__IGHJ4*01 | 1021 | gnl|Fabrus|L5__IGKJ1*01 | 1096 |
| 503 | gnl|Fabrus|VH4-34__IGHD5-12*01__IGHJ4*01 | 1022 | gnl|Fabrus|L5__IGKJ1*01 | 1096 |
| 504 | gnl|Fabrus|VH4-34__IGHD6-13*01__IGHJ4*01 | 1023 | gnl|Fabrus|L5__IGKJ1*01 | 1096 |
| 505 | gnl|Fabrus|VH4-34__IGHD6-25*01__IGHJ6*01 | 1024 | gnl|Fabrus|L5__IGKJ1*01 | 1096 |
| 506 | gnl|Fabrus|VH4-34__IGHD7-27*01__IGHJ4*01 | 1026 | gnl|Fabrus|L5__IGKJ1*01 | 1096 |
| 507 | gnl|Fabrus|VH2-26__IGHD1-20*01__IGHJ4*01 | 789 | gnl|Fabrus|L5__IGKJ1*01 | 1096 |
| 508 | gnl|Fabrus|VH2-26__IGHD2-2*01__IGHJ4*01 | 791 | gnl|Fabrus|L5__IGKJ1*01 | 1096 |
| 509 | gnl|Fabrus|VH2-26__IGHD3-10*01__IGHJ4*01 | 792 | gnl|Fabrus|L5__IGKJ1*01 | 1096 |
| 510 | gnl|Fabrus|VH2-26__IGHD4-11*01__IGHJ4*01 | 794 | gnl|Fabrus|L5__IGKJ1*01 | 1096 |
| 511 | gnl|Fabrus|VH2-26__IGHD5-18*01__IGHJ4*01 | 796 | gnl|Fabrus|L5__IGKJ1*01 | 1096 |
| 512 | gnl|Fabrus|VH2-26__IGHD6-13*01__IGHJ4*01 | 797 | gnl|Fabrus|L5__IGKJ1*01 | 1096 |
| 513 | gnl|Fabrus|VH2-26__IGHD7-27*01__IGHJ4*01 | 798 | gnl|Fabrus|L5__IGKJ1*01 | 1096 |
| 514 | gnl|Fabrus|VH5-51__IGHD1-14*01__IGHJ4*01 | 1044 | gnl|Fabrus|L5__IGKJ1*01 | 1096 |
| 515 | gnl|Fabrus|VH5-51__IGHD2-8*01__IGHJ4*01 | 1046 | gnl|Fabrus|L5__IGKJ1*01 | 1096 |
| 516 | gnl|Fabrus|VH5-51__IGHD3-3*01__IGHJ4*01 | 1048 | gnl|Fabrus|L5__IGKJ1*01 | 1096 |
| 517 | gnl|Fabrus|VH5-51__IGHD4-17*01__IGHJ4*01 | 1049 | gnl|Fabrus|L5__IGKJ1*01 | 1096 |
| 518 | gnl|Fabrus|VH5-51__IGHD5-18*01__IGHJ4*01 | 1050 | gnl|Fabrus|L5__IGKJ1*01 | 1096 |
| 519 | gnl|Fabrus|VH5-51__IGHD5-18*01__IGHJ4*01 | 1051 | gnl|Fabrus|L5__IGKJ1*01 | 1096 |
| 520 | gnl|Fabrus|VH5-51__IGHD6-25*01__IGHJ4*01 | 1052 | gnl|Fabrus|L5__IGKJ1*01 | 1096 |
| 521 | gnl|Fabrus|VH5-51__IGHD7-27*01__IGHJ4*01 | 1053 | gnl|Fabrus|L5__IGKJ1*01 | 1096 |
| 522 | gnl|Fabrus|VH6-1__IGHD1-1*01__IGHJ4*01 | 1054 | gnl|Fabrus|L5__IGKJ1*01 | 1096 |
| 523 | gnl|Fabrus|VH6-1__IGHD2-15*01__IGHJ4*01 | 1056 | gnl|Fabrus|L5__IGKJ1*01 | 1096 |
| 524 | gnl|Fabrus|VH6-1__IGHD3-3*01__IGHJ4*01 | 1059 | gnl|Fabrus|L5__IGKJ1*01 | 1096 |
| 525 | gnl|Fabrus|VH6-1__IGHD4-23*01__IGHJ4*01 | 1061 | gnl|Fabrus|L5__IGKJ1*01 | 1096 |
| 526 | gnl|Fabrus|VH6-1__IGHD4-11*01__IGHJ6*01 | 1060 | gnl|Fabrus|L5__IGKJ1*01 | 1096 |
| 527 | gnl|Fabrus|VH6-1__IGHD5-5*01__IGHJ4*01 | 1062 | gnl|Fabrus|L5__IGKJ1*01 | 1096 |
| 528 | gnl|Fabrus|VH6-1__IGHD6-13*01__IGHJ4*01 | 1063 | gnl|Fabrus|L5__IGKJ1*01 | 1096 |
| 529 | gnl|Fabrus|VH6-1__IGHD6-25*01__IGHJ6*01 | 1064 | gnl|Fabrus|L5__IGKJ1*01 | 1096 |
| 530 | gnl|Fabrus|VH6-1__IGHD7-27*01__IGHJ4*01 | 1065 | gnl|Fabrus|L5__IGKJ1*01 | 1096 |
| 531 | gnl|Fabrus|VH4-59__IGHD6-25*01__IGHJ3*01 | 1043 | gnl|Fabrus|L5__IGKJ1*01 | 1096 |
| 532 | gnl|Fabrus|VH3-48__IGHD6-6*01__IGHJ1*01 | 923 | gnl|Fabrus|L5__IGKJ1*01 | 1096 |
| 533 | gnl|Fabrus|VH3-30__IGHD6-6*01__IGHJ1*01 | 893 | gnl|Fabrus|L5__IGKJ1*01 | 1096 |
| 534 | gnl|Fabrus|VH3-66__IGHD6-6*01__IGHJ1*01 | 949 | gnl|Fabrus|L5__IGKJ1*01 | 1096 |
| 535 | gnl|Fabrus|VH3-53__IGHD5-5*01__IGHJ4*01 | 938 | gnl|Fabrus|L5__IGKJ1*01 | 1096 |

TABLE 4-continued

Exemplary Paired Nucleic Acid Library

| | HEAVY CHAIN | SEQ ID NO | LIGHT CHAIN | SEQ ID NO |
|---|---|---|---|---|
| 536 | gnl\|Fabrus\|VH2-5__IGHD5-12*01__IGHJ4*01 | 804 | gnl\|Fabrus\|L5__IGKJ1*01 | 1096 |
| 537 | gnl\|Fabrus\|VH2-70__IGHD5-12*01__IGHJ4*01 | 811 | gnl\|Fabrus\|L5__IGKJ1*01 | 1096 |
| 538 | gnl\|Fabrus\|VH3-15__IGHD5-12*01__IGHJ4*01 | 835 | gnl\|Fabrus\|L5__IGKJ1*01 | 1096 |
| 539 | gnl\|Fabrus\|VH3-15__IGHD3-10*01__IGHJ4*01 | 833 | gnl\|Fabrus\|L5__IGKJ1*01 | 1096 |
| 540 | gnl\|Fabrus\|VH3-49__IGHD5-18*01__IGHJ4*01 | 930 | gnl\|Fabrus\|L5__IGKJ1*01 | 1096 |
| 541 | gnl\|Fabrus\|VH3-49__IGHD6-13*01__IGHJ4*01 | 931 | gnl\|Fabrus\|L5__IGKJ1*01 | 1096 |
| 542 | gnl\|Fabrus\|VH3-72__IGHD5-18*01__IGHJ4*01 | 967 | gnl\|Fabrus\|L5__IGKJ1*01 | 1096 |
| 543 | gnl\|Fabrus\|VH3-72__IGHD6-6*01__IGHJ1*01 | 969 | gnl\|Fabrus\|L5__IGKJ1*01 | 1096 |
| 544 | gnl\|Fabrus\|VH3-73__IGHD5-12*01__IGHJ4*01 | 977 | gnl\|Fabrus\|L5__IGKJ1*01 | 1096 |
| 545 | gnl\|Fabrus\|VH3-73__IGHD4-23*01__IGHJ5*01 | 976 | gnl\|Fabrus\|L5__IGKJ1*01 | 1096 |
| 546 | gnl\|Fabrus\|VH3-43__IGHD3-22*01__IGHJ4*01 | 918 | gnl\|Fabrus\|L5__IGKJ1*01 | 1096 |
| 547 | gnl\|Fabrus\|VH3-43__IGHD6-13*01__IGHJ4*01 | 921 | gnl\|Fabrus\|L5__IGKJ1*01 | 1096 |
| 548 | gnl\|Fabrus\|VH3-9__IGHD3-22*01__IGHJ4*01 | 992 | gnl\|Fabrus\|L5__IGKJ1*01 | 1096 |
| 549 | gnl\|Fabrus\|VH3-9__IGHD1-7*01__IGHJ5*01 | 989 | gnl\|Fabrus\|L5__IGKJ1*01 | 1096 |
| 550 | gnl\|Fabrus\|VH3-9__IGHD6-13*01__IGHJ4*01 | 995 | gnl\|Fabrus\|L5__IGKJ1*01 | 1096 |
| 551 | gnl\|Fabrus\|VH4-39__IGHD3-10*01__IGHJ4*01 | 1030 | gnl\|Fabrus\|L5__IGKJ1*01 | 1096 |
| 552 | gnl\|Fabrus\|VH4-39__IGHD5-12*01__IGHJ4*01 | 1034 | gnl\|Fabrus\|L5__IGKJ1*01 | 1096 |
| 553 | gnl\|Fabrus\|VH1-18__IGHD6-6*01__IGHJ1*01 | 728 | gnl\|Fabrus\|L5__IGKJ1*01 | 1096 |
| 554 | gnl\|Fabrus\|VH1-24__IGHD5-12*01__IGHJ4*01 | 735 | gnl\|Fabrus\|L5__IGKJ1*01 | 1096 |
| 555 | gnl\|Fabrus\|VH1-2__IGHD1-1*01__IGHJ3*01 | 729 | gnl\|Fabrus\|L5__IGKJ1*01 | 1096 |
| 556 | gnl\|Fabrus\|VH1-3__IGHD6-6*01__IGHJ1*01 | 743 | gnl\|Fabrus\|L5__IGKJ1*01 | 1096 |
| 557 | gnl\|Fabrus\|VH1-45__IGHD3-10*01__IGHJ4*01 | 748 | gnl\|Fabrus\|L5__IGKJ1*01 | 1096 |
| 558 | gnl\|Fabrus\|VH1-46__IGHD1-26*01__IGHJ1*01 | 754 | gnl\|Fabrus\|L5__IGKJ1*01 | 1096 |
| 559 | gnl\|Fabrus\|VH7-81__IGHD2-21*01__IGHJ6*01 | 1068 | gnl\|Fabrus\|L5__IGKJ1*01 | 1096 |
| 560 | gnl\|Fabrus\|VH2-70__IGHD3-9*01__IGHJ6*01 | 810 | gnl\|Fabrus\|L5__IGKJ1*01 | 1096 |
| 561 | gnl\|Fabrus\|VH1-58__IGHD3-10*01__IGHJ6*01 | 764 | gnl\|Fabrus\|L5__IGKJ1*01 | 1096 |
| 562 | gnl\|Fabrus\|VH7-81__IGHD2-21*01__IGHJ2*01 | 1067 | gnl\|Fabrus\|L5__IGKJ1*01 | 1096 |
| 563 | gnl\|Fabrus\|VH4-28__IGHD3-9*01__IGHJ6*01 | 1002 | gnl\|Fabrus\|L5__IGKJ1*01 | 1096 |
| 564 | gnl\|Fabrus\|VH4-31__IGHD2-15*01__IGHJ2*01 | 1008 | gnl\|Fabrus\|L5__IGKJ1*01 | 1096 |
| 565 | gnl\|Fabrus\|VH2-5__IGHD3-9*01__IGHJ6*01 | 803 | gnl\|Fabrus\|L5__IGKJ1*01 | 1096 |
| 566 | gnl\|Fabrus\|VH1-8__IGHD2-15*01__IGHJ6*01 | 783 | gnl\|Fabrus\|L5__IGKJ1*01 | 1096 |
| 567 | gnl\|Fabrus\|VH2-70__IGHD2-15*01__IGHJ2*01 | 808 | gnl\|Fabrus\|L5__IGKJ1*01 | 1096 |
| 568 | gnl\|Fabrus\|VH3-38__IGHD3-10*01__IGHJ4*01 | 907 | gnl\|Fabrus\|L5__IGKJ1*01 | 1096 |
| 569 | gnl\|Fabrus\|VH3-16__IGHD1-7*01__IGHJ6*01 | 838 | gnl\|Fabrus\|L5__IGKJ1*01 | 1096 |
| 570 | gnl\|Fabrus\|VH3-73__IGHD3-9*01__IGHJ6*01 | 974 | gnl\|Fabrus\|L5__IGKJ1*01 | 1096 |
| 571 | gnl\|Fabrus\|VH3-11__IGHD3-9*01__IGHJ6*01 | 816 | gnl\|Fabrus\|L5__IGKJ1*01 | 1096 |
| 572 | gnl\|Fabrus\|VH3-11__IGHD6-6*01__IGHJ1*01 | 820 | gnl\|Fabrus\|L5__IGKJ1*01 | 1096 |
| 573 | gnl\|Fabrus\|VH3-20__IGHD5-12*01__IGHJ4*01 | 852 | gnl\|Fabrus\|L5__IGKJ1*01 | 1096 |
| 574 | gnl\|Fabrus\|VH3-16__IGHD2-15*01__IGHJ2*01 | 839 | gnl\|Fabrus\|L5__IGKJ1*01 | 1096 |
| 575 | gnl\|Fabrus\|VH3-7__IGHD6-6*01__IGHJ1*01 | 960 | gnl\|Fabrus\|L5__IGKJ1*01 | 1096 |
| 576 | gnl\|Fabrus\|VH3-16__IGHD6-13*01__IGHJ4*01 | 844 | gnl\|Fabrus\|L5__IGKJ1*01 | 1096 |
| 577 | gnl\|Fabrus\|VH3-23__IGHD1-1*01__IGHJ4*01 | 863 | gnl\|Fabrus\|L8__IGKJ1*01 | 1098 |
| 578 | gnl\|Fabrus\|VH3-23__IGHD2-15*01__IGHJ4*01 | 866 | gnl\|Fabrus\|L8__IGKJ1*01 | 1098 |
| 579 | gnl\|Fabrus\|VH3-23__IGHD3-22*01__IGHJ4*01 | 870 | gnl\|Fabrus\|L8__IGKJ1*01 | 1098 |
| 580 | gnl\|Fabrus\|VH3-23__IGHD4-11*01__IGHJ4*01 | 872 | gnl\|Fabrus\|L8__IGKJ1*01 | 1098 |
| 581 | gnl\|Fabrus\|VH3-23__IGHD5-12*01__IGHJ4*01 | 874 | gnl\|Fabrus\|L8__IGKJ1*01 | 1098 |
| 582 | gnl\|Fabrus\|VH3-23__IGHD5-5*01__IGHJ4*01 | 876 | gnl\|Fabrus\|L8__IGKJ1*01 | 1098 |
| 583 | gnl\|Fabrus\|VH3-23__IGHD6-13*01__IGHJ4*01 | 877 | gnl\|Fabrus\|L8__IGKJ1*01 | 1098 |
| 584 | gnl\|Fabrus\|VH3-23__IGHD7-27*01__IGHJ4*01 | 880 | gnl\|Fabrus\|L8__IGKJ1*01 | 1098 |
| 585 | gnl\|Fabrus\|VH3-23__IGHD7-27*01__IGHJ6*01 | 881 | gnl\|Fabrus\|L8__IGKJ1*01 | 1098 |
| 586 | gnl\|Fabrus\|VH1-69__IGHD1-14*01__IGHJ4*01 | 770 | gnl\|Fabrus\|L8__IGKJ1*01 | 1098 |
| 587 | gnl\|Fabrus\|VH1-69__IGHD2-2*01__IGHJ4*01 | 771 | gnl\|Fabrus\|L8__IGKJ1*01 | 1098 |
| 588 | gnl\|Fabrus\|VH1-69__IGHD2-8*01__IGHJ6*01 | 772 | gnl\|Fabrus\|L8__IGKJ1*01 | 1098 |
| 589 | gnl\|Fabrus\|VH1-69__IGHD3-16*01__IGHJ4*01 | 773 | gnl\|Fabrus\|L8__IGKJ1*01 | 1098 |
| 590 | gnl\|Fabrus\|VH1-69__IGHD3-3*01__IGHJ4*01 | 774 | gnl\|Fabrus\|L8__IGKJ1*01 | 1098 |
| 591 | gnl\|Fabrus\|VH1-69__IGHD4-17*01__IGHJ4*01 | 776 | gnl\|Fabrus\|L8__IGKJ1*01 | 1098 |
| 592 | gnl\|Fabrus\|VH1-69__IGHD5-12*01__IGHJ4*01 | 777 | gnl\|Fabrus\|L8__IGKJ1*01 | 1098 |
| 593 | gnl\|Fabrus\|VH1-69__IGHD6-19*01__IGHJ4*01 | 779 | gnl\|Fabrus\|L8__IGKJ1*01 | 1098 |
| 594 | gnl\|Fabrus\|VH1-69__IGHD7-27*01__IGHJ4*01 | 781 | gnl\|Fabrus\|L8__IGKJ1*01 | 1098 |
| 595 | gnl\|Fabrus\|VH4-34__IGHD1-7*01__IGHJ4*01 | 1017 | gnl\|Fabrus\|L8__IGKJ1*01 | 1098 |
| 596 | gnl\|Fabrus\|VH4-34__IGHD2-2*01__IGHJ4*01 | 1018 | gnl\|Fabrus\|L8__IGKJ1*01 | 1098 |
| 597 | gnl\|Fabrus\|VH4-34__IGHD3-16*01__IGHJ4*01 | 1019 | gnl\|Fabrus\|L8__IGKJ1*01 | 1098 |
| 598 | gnl\|Fabrus\|VH4-34__IGHD4-17*01__IGHJ4*01 | 1021 | gnl\|Fabrus\|L8__IGKJ1*01 | 1098 |
| 599 | gnl\|Fabrus\|VH4-34__IGHD5-12*01__IGHJ4*01 | 1022 | gnl\|Fabrus\|L8__IGKJ1*01 | 1098 |
| 600 | gnl\|Fabrus\|VH4-34__IGHD6-13*01__IGHJ4*01 | 1023 | gnl\|Fabrus\|L8__IGKJ1*01 | 1098 |
| 601 | gnl\|Fabrus\|VH4-34__IGHD6-25*01__IGHJ6*01 | 1024 | gnl\|Fabrus\|L8__IGKJ1*01 | 1098 |
| 602 | gnl\|Fabrus\|VH4-34__IGHD7-27*01__IGHJ4*01 | 1026 | gnl\|Fabrus\|L8__IGKJ1*01 | 1098 |
| 603 | gnl\|Fabrus\|VH2-26__IGHD1-20*01__IGHJ4*01 | 789 | gnl\|Fabrus\|L8__IGKJ1*01 | 1098 |
| 604 | gnl\|Fabrus\|VH2-26__IGHD2-2*01__IGHJ4*01 | 791 | gnl\|Fabrus\|L8__IGKJ1*01 | 1098 |
| 605 | gnl\|Fabrus\|VH2-26__IGHD3-10*01__IGHJ4*01 | 792 | gnl\|Fabrus\|L8__IGKJ1*01 | 1098 |
| 606 | gnl\|Fabrus\|VH2-26__IGHD4-11*01__IGHJ4*01 | 794 | gnl\|Fabrus\|L8__IGKJ1*01 | 1098 |
| 607 | gnl\|Fabrus\|VH2-26__IGHD5-18*01__IGHJ4*01 | 796 | gnl\|Fabrus\|L8__IGKJ1*01 | 1098 |
| 608 | gnl\|Fabrus\|VH2-26__IGHD6-13*01__IGHJ4*01 | 797 | gnl\|Fabrus\|L8__IGKJ1*01 | 1098 |
| 609 | gnl\|Fabrus\|VH2-26__IGHD7-27*01__IGHJ4*01 | 798 | gnl\|Fabrus\|L8__IGKJ1*01 | 1098 |

TABLE 4-continued

Exemplary Paired Nucleic Acid Library

| | HEAVY CHAIN | SEQ ID NO | LIGHT CHAIN | SEQ ID NO |
|---|---|---|---|---|
| 610 | gnl\|Fabrus\|VH5-51__IGHD1-14*01__IGHJ4*01 | 1044 | gnl\|Fabrus\|L8__IGKJ1*01 | 1098 |
| 611 | gnl\|Fabrus\|VH5-51__IGHD2-8*01__IGHJ4*01 | 1046 | gnl\|Fabrus\|L8__IGKJ1*01 | 1098 |
| 612 | gnl\|Fabrus\|VH5-51__IGHD3-3*01__IGHJ4*01 | 1048 | gnl\|Fabrus\|L8__IGKJ1*01 | 1098 |
| 613 | gnl\|Fabrus\|VH5-51__IGHD4-17*01__IGHJ4*01 | 1049 | gnl\|Fabrus\|L8__IGKJ1*01 | 1098 |
| 614 | gnl\|Fabrus\|VH5-51__IGHD5-18*01__IGHJ4*01 | 1050 | gnl\|Fabrus\|L8__IGKJ1*01 | 1098 |
| 615 | gnl\|Fabrus\|VH5-51__IGHD5-18*01__IGHJ4*01 | 1051 | gnl\|Fabrus\|L8__IGKJ1*01 | 1098 |
| 616 | gnl\|Fabrus\|VH5-51__IGHD6-25*01__IGHJ4*01 | 1052 | gnl\|Fabrus\|L8__IGKJ1*01 | 1098 |
| 617 | gnl\|Fabrus\|VH5-51__IGHD7-27*01__IGHJ4*01 | 1053 | gnl\|Fabrus\|L8__IGKJ1*01 | 1098 |
| 618 | gnl\|Fabrus\|VH6-1__IGHD1-1*01__IGHJ4*01 | 1054 | gnl\|Fabrus\|L8__IGKJ1*01 | 1098 |
| 619 | gnl\|Fabrus\|VH6-1__IGHD2-15*01__IGHJ4*01 | 1056 | gnl\|Fabrus\|L8__IGKJ1*01 | 1098 |
| 620 | gnl\|Fabrus\|VH6-1__IGHD3-3*01__IGHJ4*01 | 1059 | gnl\|Fabrus\|L8__IGKJ1*01 | 1098 |
| 621 | gnl\|Fabrus\|VH6-1__IGHD4-23*01__IGHJ4*01 | 1061 | gnl\|Fabrus\|L8__IGKJ1*01 | 1098 |
| 622 | gnl\|Fabrus\|VH6-1__IGHD4-11*01__IGHJ6*01 | 1060 | gnl\|Fabrus\|L8__IGKJ1*01 | 1098 |
| 623 | gnl\|Fabrus\|VH6-1__IGHD5-5*01__IGHJ4*01 | 1062 | gnl\|Fabrus\|L8__IGKJ1*01 | 1098 |
| 624 | gnl\|Fabrus\|VH6-1__IGHD6-13*01__IGHJ4*01 | 1063 | gnl\|Fabrus\|L8__IGKJ1*01 | 1098 |
| 625 | gnl\|Fabrus\|VH6-1__IGHD6-25*01__IGHJ6*01 | 1064 | gnl\|Fabrus\|L8__IGKJ1*01 | 1098 |
| 626 | gnl\|Fabrus\|VH6-1__IGHD7-27*01__IGHJ4*01 | 1065 | gnl\|Fabrus\|L8__IGKJ1*01 | 1098 |
| 627 | gnl\|Fabrus\|VH4-59__IGHD6-25*01__IGHJ3*01 | 1043 | gnl\|Fabrus\|L8__IGKJ1*01 | 1098 |
| 628 | gnl\|Fabrus\|VH3-48__IGHD6-6*01__IGHJ1*01 | 923 | gnl\|Fabrus\|L8__IGKJ1*01 | 1098 |
| 629 | gnl\|Fabrus\|VH3-30__IGHD6-6*01__IGHJ1*01 | 893 | gnl\|Fabrus\|L8__IGKJ1*01 | 1098 |
| 630 | gnl\|Fabrus\|VH3-66__IGHD6-6*01__IGHJ1*01 | 949 | gnl\|Fabrus\|L8__IGKJ1*01 | 1098 |
| 631 | gnl\|Fabrus\|VH3-53__IGHD5-5*01__IGHJ4*01 | 938 | gnl\|Fabrus\|L8__IGKJ1*01 | 1098 |
| 632 | gnl\|Fabrus\|VH2-5__IGHD5-12*01__IGHJ4*01 | 804 | gnl\|Fabrus\|L8__IGKJ1*01 | 1098 |
| 633 | gnl\|Fabrus\|VH2-70__IGHD5-12*01__IGHJ4*01 | 811 | gnl\|Fabrus\|L8__IGKJ1*01 | 1098 |
| 634 | gnl\|Fabrus\|VH3-15__IGHD5-12*01__IGHJ4*01 | 835 | gnl\|Fabrus\|L8__IGKJ1*01 | 1098 |
| 635 | gnl\|Fabrus\|VH3-15__IGHD3-10*01__IGHJ4*01 | 833 | gnl\|Fabrus\|L8__IGKJ1*01 | 1098 |
| 636 | gnl\|Fabrus\|VH3-49__IGHD5-18*01__IGHJ4*01 | 930 | gnl\|Fabrus\|L8__IGKJ1*01 | 1098 |
| 637 | gnl\|Fabrus\|VH3-49__IGHD6-13*01__IGHJ4*01 | 931 | gnl\|Fabrus\|L8__IGKJ1*01 | 1098 |
| 638 | gnl\|Fabrus\|VH3-72__IGHD5-18*01__IGHJ4*01 | 967 | gnl\|Fabrus\|L8__IGKJ1*01 | 1098 |
| 639 | gnl\|Fabrus\|VH3-72__IGHD6-6*01__IGHJ1*01 | 969 | gnl\|Fabrus\|L8__IGKJ1*01 | 1098 |
| 640 | gnl\|Fabrus\|VH3-73__IGHD5-12*01__IGHJ4*01 | 977 | gnl\|Fabrus\|L8__IGKJ1*01 | 1098 |
| 641 | gnl\|Fabrus\|VH3-73__IGHD4-23*01__IGHJ5*01 | 976 | gnl\|Fabrus\|L8__IGKJ1*01 | 1098 |
| 642 | gnl\|Fabrus\|VH3-43__IGHD3-22*01__IGHJ4*01 | 918 | gnl\|Fabrus\|L8__IGKJ1*01 | 1098 |
| 643 | gnl\|Fabrus\|VH3-43__IGHD6-13*01__IGHJ4*01 | 921 | gnl\|Fabrus\|L8__IGKJ1*01 | 1098 |
| 644 | gnl\|Fabrus\|VH3-9__IGHD3-22*01__IGHJ4*01 | 992 | gnl\|Fabrus\|L8__IGKJ1*01 | 1098 |
| 645 | gnl\|Fabrus\|VH3-9__IGHD1-7*01__IGHJ5*01 | 989 | gnl\|Fabrus\|L8__IGKJ1*01 | 1098 |
| 646 | gnl\|Fabrus\|VH3-9__IGHD6-13*01__IGHJ4*01 | 995 | gnl\|Fabrus\|L8__IGKJ1*01 | 1098 |
| 647 | gnl\|Fabrus\|VH4-39__IGHD3-10*01__IGHJ4*01 | 1030 | gnl\|Fabrus\|L8__IGKJ1*01 | 1098 |
| 648 | gnl\|Fabrus\|VH4-39__IGHD5-12*01__IGHJ4*01 | 1034 | gnl\|Fabrus\|L8__IGKJ1*01 | 1098 |
| 649 | gnl\|Fabrus\|VH1-18__IGHD6-6*01__IGHJ1*01 | 728 | gnl\|Fabrus\|L8__IGKJ1*01 | 1098 |
| 650 | gnl\|Fabrus\|VH1-24__IGHD5-12*01__IGHJ4*01 | 735 | gnl\|Fabrus\|L8__IGKJ1*01 | 1098 |
| 651 | gnl\|Fabrus\|VH1-2__IGHD1-1*01__IGHJ3*01 | 729 | gnl\|Fabrus\|L8__IGKJ1*01 | 1098 |
| 652 | gnl\|Fabrus\|VH1-3__IGHD6-6*01__IGHJ1*01 | 743 | gnl\|Fabrus\|L8__IGKJ1*01 | 1098 |
| 653 | gnl\|Fabrus\|VH1-45__IGHD3-10*01__IGHJ4*01 | 748 | gnl\|Fabrus\|L8__IGKJ1*01 | 1098 |
| 654 | gnl\|Fabrus\|VH1-46__IGHD1-26*01__IGHJ4*01 | 754 | gnl\|Fabrus\|L8__IGKJ1*01 | 1098 |
| 655 | gnl\|Fabrus\|VH7-81__IGHD2-21*01__IGHJ6*01 | 1068 | gnl\|Fabrus\|L8__IGKJ1*01 | 1098 |
| 656 | gnl\|Fabrus\|VH2-70__IGHD3-9*01__IGHJ6*01 | 810 | gnl\|Fabrus\|L8__IGKJ1*01 | 1098 |
| 657 | gnl\|Fabrus\|VH1-58__IGHD3-10*01__IGHJ6*01 | 764 | gnl\|Fabrus\|L8__IGKJ1*01 | 1098 |
| 658 | gnl\|Fabrus\|VH7-81__IGHD2-21*01__IGHJ2*01 | 1067 | gnl\|Fabrus\|L8__IGKJ1*01 | 1098 |
| 659 | gnl\|Fabrus\|VH4-28__IGHD3-9*01__IGHJ6*01 | 1002 | gnl\|Fabrus\|L8__IGKJ1*01 | 1098 |
| 660 | gnl\|Fabrus\|VH4-31__IGHD2-15*01__IGHJ2*01 | 1008 | gnl\|Fabrus\|L8__IGKJ1*01 | 1098 |
| 661 | gnl\|Fabrus\|VH2-5__IGHD3-9*01__IGHJ6*01 | 803 | gnl\|Fabrus\|L8__IGKJ1*01 | 1098 |
| 662 | gnl\|Fabrus\|VH1-8__IGHD2-15*01__IGHJ6*01 | 783 | gnl\|Fabrus\|L8__IGKJ1*01 | 1098 |
| 663 | gnl\|Fabrus\|VH2-70__IGHD2-15*01__IGHJ2*01 | 808 | gnl\|Fabrus\|L8__IGKJ1*01 | 1098 |
| 664 | gnl\|Fabrus\|VH3-38__IGHD3-10*01__IGHJ4*01 | 907 | gnl\|Fabrus\|L8__IGKJ1*01 | 1098 |
| 665 | gnl\|Fabrus\|VH3-16__IGHD1-7*01__IGHJ6*01 | 838 | gnl\|Fabrus\|L8__IGKJ1*01 | 1098 |
| 666 | gnl\|Fabrus\|VH3-73__IGHD3-9*01__IGHJ6*01 | 974 | gnl\|Fabrus\|L8__IGKJ1*01 | 1098 |
| 667 | gnl\|Fabrus\|VH3-11__IGHD3-9*01__IGHJ6*01 | 816 | gnl\|Fabrus\|L8__IGKJ1*01 | 1098 |
| 668 | gnl\|Fabrus\|VH3-11__IGHD6-6*01__IGHJ1*01 | 820 | gnl\|Fabrus\|L8__IGKJ1*01 | 1098 |
| 669 | gnl\|Fabrus\|VH3-20__IGHD5-12*01__IGHJ4*01 | 852 | gnl\|Fabrus\|L8__IGKJ1*01 | 1098 |
| 670 | gnl\|Fabrus\|VH3-16__IGHD2-15*01__IGHJ2*01 | 839 | gnl\|Fabrus\|L8__IGKJ1*01 | 1098 |
| 671 | gnl\|Fabrus\|VH3-7__IGHD6-6*01__IGHJ1*01 | 960 | gnl\|Fabrus\|L8__IGKJ1*01 | 1098 |
| 672 | gnl\|Fabrus\|VH3-16__IGHD6-13*01__IGHJ4*01 | 844 | gnl\|Fabrus\|L8__IGKJ1*01 | 1098 |
| 673 | gnl\|Fabrus\|VH3-23__IGHD1-1*01__IGHJ4*01 | 863 | gnl\|Fabrus\|L11__IGKJ1*01 | 1087 |
| 674 | gnl\|Fabrus\|VH3-23__IGHD2-15*01__IGHJ4*01 | 866 | gnl\|Fabrus\|L11__IGKJ1*01 | 1087 |
| 675 | gnl\|Fabrus\|VH3-23__IGHD3-22*01__IGHJ4*01 | 870 | gnl\|Fabrus\|L11__IGKJ1*01 | 1087 |
| 676 | gnl\|Fabrus\|VH3-23__IGHD4-11*01__IGHJ4*01 | 872 | gnl\|Fabrus\|L11__IGKJ1*01 | 1087 |
| 677 | gnl\|Fabrus\|VH3-23__IGHD5-12*01__IGHJ4*01 | 874 | gnl\|Fabrus\|L11__IGKJ1*01 | 1087 |
| 678 | gnl\|Fabrus\|VH3-23__IGHD5-5*01__IGHJ4*01 | 876 | gnl\|Fabrus\|L11__IGKJ1*01 | 1087 |
| 679 | gnl\|Fabrus\|VH3-23__IGHD6-13*01__IGHJ4*01 | 877 | gnl\|Fabrus\|L11__IGKJ1*01 | 1087 |
| 680 | gnl\|Fabrus\|VH3-23__IGHD7-27*01__IGHJ4*01 | 880 | gnl\|Fabrus\|L11__IGKJ1*01 | 1087 |
| 681 | gnl\|Fabrus\|VH3-23__IGHD7-27*01__IGHJ6*01 | 881 | gnl\|Fabrus\|L11__IGKJ1*01 | 1087 |
| 682 | gnl\|Fabrus\|VH1-69__IGHD1-14*01__IGHJ4*01 | 770 | gnl\|Fabrus\|L11__IGKJ1*01 | 1087 |
| 683 | gnl\|Fabrus\|VH1-69__IGHD2-2*01__IGHJ4*01 | 771 | gnl\|Fabrus\|L11__IGKJ1*01 | 1087 |

TABLE 4-continued

Exemplary Paired Nucleic Acid Library

| | HEAVY CHAIN | SEQ ID NO | LIGHT CHAIN | SEQ ID NO |
|---|---|---|---|---|
| 684 | gnl|Fabrus|VH1-69__IGHD2-8*01__IGHJ6*01 | 772 | gnl|Fabrus|L11__IGKJ1*01 | 1087 |
| 685 | gnl|Fabrus|VH1-69__IGHD3-16*01__IGHJ4*01 | 773 | gnl|Fabrus|L11__IGKJ1*01 | 1087 |
| 686 | gnl|Fabrus|VH1-69__IGHD3-3*01__IGHJ4*01 | 774 | gnl|Fabrus|L11__IGKJ1*01 | 1087 |
| 687 | gnl|Fabrus|VH1-69__IGHD4-17*01__IGHJ4*01 | 776 | gnl|Fabrus|L11__IGKJ1*01 | 1087 |
| 688 | gnl|Fabrus|VH1-69__IGHD5-12*01__IGHJ4*01 | 777 | gnl|Fabrus|L11__IGKJ1*01 | 1087 |
| 689 | gnl|Fabrus|VH1-69__IGHD6-19*01__IGHJ4*01 | 779 | gnl|Fabrus|L11__IGKJ1*01 | 1087 |
| 690 | gnl|Fabrus|VH1-69__IGHD7-27*01__IGHJ4*01 | 781 | gnl|Fabrus|L11__IGKJ1*01 | 1087 |
| 691 | gnl|Fabrus|VH4-34__IGHD1-7*01__IGHJ4*01 | 1017 | gnl|Fabrus|L11__IGKJ1*01 | 1087 |
| 692 | gnl|Fabrus|VH4-34__IGHD2-2*01__IGHJ4*01 | 1018 | gnl|Fabrus|L11__IGKJ1*01 | 1087 |
| 693 | gnl|Fabrus|VH4-34__IGHD3-16*01__IGHJ4*01 | 1019 | gnl|Fabrus|L11__IGKJ1*01 | 1087 |
| 694 | gnl|Fabrus|VH4-34__IGHD4-17*01__IGHJ4*01 | 1021 | gnl|Fabrus|L11__IGKJ1*01 | 1087 |
| 695 | gnl|Fabrus|VH4-34__IGHD5-12*01__IGHJ4*01 | 1022 | gnl|Fabrus|L11__IGKJ1*01 | 1087 |
| 696 | gnl|Fabrus|VH4-34__IGHD6-13*01__IGHJ4*01 | 1023 | gnl|Fabrus|L11__IGKJ1*01 | 1087 |
| 697 | gnl|Fabrus|VH4-34__IGHD6-25*01__IGHJ6*01 | 1024 | gnl|Fabrus|L11__IGKJ1*01 | 1087 |
| 698 | gnl|Fabrus|VH4-34__IGHD7-27*01__IGHJ4*01 | 1026 | gnl|Fabrus|L11__IGKJ1*01 | 1087 |
| 699 | gnl|Fabrus|VH2-26__IGHD1-20*01__IGHJ4*01 | 789 | gnl|Fabrus|L11__IGKJ1*01 | 1087 |
| 700 | gnl|Fabrus|VH2-26__IGHD2-2*01__IGHJ4*01 | 791 | gnl|Fabrus|L11__IGKJ1*01 | 1087 |
| 701 | gnl|Fabrus|VH2-26__IGHD3-10*01__IGHJ4*01 | 792 | gnl|Fabrus|L11__IGKJ1*01 | 1087 |
| 702 | gnl|Fabrus|VH2-26__IGHD4-11*01__IGHJ4*01 | 794 | gnl|Fabrus|L11__IGKJ1*01 | 1087 |
| 703 | gnl|Fabrus|VH2-26__IGHD5-18*01__IGHJ4*01 | 796 | gnl|Fabrus|L11__IGKJ1*01 | 1087 |
| 704 | gnl|Fabrus|VH2-26__IGHD6-13*01__IGHJ4*01 | 797 | gnl|Fabrus|L11__IGKJ1*01 | 1087 |
| 705 | gnl|Fabrus|VH2-26__IGHD7-27*01__IGHJ4*01 | 798 | gnl|Fabrus|L11__IGKJ1*01 | 1087 |
| 706 | gnl|Fabrus|VH5-51__IGHD1-14*01__IGHJ4*01 | 1044 | gnl|Fabrus|L11__IGKJ1*01 | 1087 |
| 707 | gnl|Fabrus|VH5-51__IGHD2-8*01__IGHJ4*01 | 1046 | gnl|Fabrus|L11__IGKJ1*01 | 1087 |
| 708 | gnl|Fabrus|VH5-51__IGHD3-3*01__IGHJ4*01 | 1048 | gnl|Fabrus|L11__IGKJ1*01 | 1087 |
| 709 | gnl|Fabrus|VH5-51__IGHD4-17*01__IGHJ4*01 | 1049 | gnl|Fabrus|L11__IGKJ1*01 | 1087 |
| 710 | gnl|Fabrus|VH5-51__IGHD5-18*01__IGHJ4*01 | 1050 | gnl|Fabrus|L11__IGKJ1*01 | 1087 |
| 711 | gnl|Fabrus|VH5-51__IGHD5-18*01__IGHJ4*01 | 1051 | gnl|Fabrus|L11__IGKJ1*01 | 1087 |
| 712 | gnl|Fabrus|VH5-51__IGHD6-25*01__IGHJ4*01 | 1052 | gnl|Fabrus|L11__IGKJ1*01 | 1087 |
| 713 | gnl|Fabrus|VH5-51__IGHD7-27*01__IGHJ4*01 | 1053 | gnl|Fabrus|L11__IGKJ1*01 | 1087 |
| 714 | gnl|Fabrus|VH6-1__IGHD1-1*01__IGHJ4*01 | 1054 | gnl|Fabrus|L11__IGKJ1*01 | 1087 |
| 715 | gnl|Fabrus|VH6-1__IGHD2-15*01__IGHJ4*01 | 1056 | gnl|Fabrus|L11__IGKJ1*01 | 1087 |
| 716 | gnl|Fabrus|VH6-1__IGHD3-3*01__IGHJ4*01 | 1059 | gnl|Fabrus|L11__IGKJ1*01 | 1087 |
| 717 | gnl|Fabrus|VH6-1__IGHD4-23*01__IGHJ4*01 | 1061 | gnl|Fabrus|L11__IGKJ1*01 | 1087 |
| 718 | gnl|Fabrus|VH6-1__IGHD4-11*01__IGHJ6*01 | 1060 | gnl|Fabrus|L11__IGKJ1*01 | 1087 |
| 719 | gnl|Fabrus|VH6-1__IGHD5-5*01__IGHJ4*01 | 1062 | gnl|Fabrus|L11__IGKJ1*01 | 1087 |
| 720 | gnl|Fabrus|VH6-1__IGHD6-13*01__IGHJ4*01 | 1063 | gnl|Fabrus|L11__IGKJ1*01 | 1087 |
| 721 | gnl|Fabrus|VH6-1__IGHD6-25*01__IGHJ6*01 | 1064 | gnl|Fabrus|L11__IGKJ1*01 | 1087 |
| 722 | gnl|Fabrus|VH6-1__IGHD7-27*01__IGHJ4*01 | 1065 | gnl|Fabrus|L11__IGKJ1*01 | 1087 |
| 723 | gnl|Fabrus|VH4-59__IGHD6-25*01__IGHJ3*01 | 1043 | gnl|Fabrus|L11__IGKJ1*01 | 1087 |
| 724 | gnl|Fabrus|VH3-48__IGHD6-6*01__IGHJ1*01 | 923 | gnl|Fabrus|L11__IGKJ1*01 | 1087 |
| 725 | gnl|Fabrus|VH3-30__IGHD6-6*01__IGHJ1*01 | 893 | gnl|Fabrus|L11__IGKJ1*01 | 1087 |
| 726 | gnl|Fabrus|VH3-66__IGHD6-6*01__IGHJ1*01 | 949 | gnl|Fabrus|L11__IGKJ1*01 | 1087 |
| 727 | gnl|Fabrus|VH3-53__IGHD5-5*01__IGHJ4*01 | 938 | gnl|Fabrus|L11__IGKJ1*01 | 1087 |
| 728 | gnl|Fabrus|VH2-5__IGHD5-12*01__IGHJ4*01 | 804 | gnl|Fabrus|L11__IGKJ1*01 | 1087 |
| 729 | gnl|Fabrus|VH2-70__IGHD5-12*01__IGHJ4*01 | 811 | gnl|Fabrus|L11__IGKJ1*01 | 1087 |
| 730 | gnl|Fabrus|VH3-15__IGHD5-12*01__IGHJ4*01 | 835 | gnl|Fabrus|L11__IGKJ1*01 | 1087 |
| 731 | gnl|Fabrus|VH3-15__IGHD3-10*01__IGHJ4*01 | 833 | gnl|Fabrus|L11__IGKJ1*01 | 1087 |
| 732 | gnl|Fabrus|VH3-49__IGHD5-18*01__IGHJ4*01 | 930 | gnl|Fabrus|L11__IGKJ1*01 | 1087 |
| 733 | gnl|Fabrus|VH3-49__IGHD6-13*01__IGHJ4*01 | 931 | gnl|Fabrus|L11__IGKJ1*01 | 1087 |
| 734 | gnl|Fabrus|VH3-72__IGHD5-18*01__IGHJ4*01 | 967 | gnl|Fabrus|L11__IGKJ1*01 | 1087 |
| 735 | gnl|Fabrus|VH3-72__IGHD6-6*01__IGHJ1*01 | 969 | gnl|Fabrus|L11__IGKJ1*01 | 1087 |
| 736 | gnl|Fabrus|VH3-73__IGHD5-12*01__IGHJ4*01 | 977 | gnl|Fabrus|L11__IGKJ1*01 | 1087 |
| 737 | gnl|Fabrus|VH3-73__IGHD4-23*01__IGHJ5*01 | 976 | gnl|Fabrus|L11__IGKJ1*01 | 1087 |
| 738 | gnl|Fabrus|VH3-43__IGHD3-22*01__IGHJ4*01 | 918 | gnl|Fabrus|L11__IGKJ1*01 | 1087 |
| 739 | gnl|Fabrus|VH3-43__IGHD6-13*01__IGHJ4*01 | 921 | gnl|Fabrus|L11__IGKJ1*01 | 1087 |
| 740 | gnl|Fabrus|VH3-9__IGHD3-22*01__IGHJ4*01 | 992 | gnl|Fabrus|L11__IGKJ1*01 | 1087 |
| 741 | gnl|Fabrus|VH3-9__IGHD1-7*01__IGHJ5*01 | 989 | gnl|Fabrus|L11__IGKJ1*01 | 1087 |
| 742 | gnl|Fabrus|VH3-9__IGHD6-13*01__IGHJ4*01 | 995 | gnl|Fabrus|L11__IGKJ1*01 | 1087 |
| 743 | gnl|Fabrus|VH4-39__IGHD3-10*01__IGHJ4*01 | 1030 | gnl|Fabrus|L11__IGKJ1*01 | 1087 |
| 744 | gnl|Fabrus|VH4-39__IGHD5-12*01__IGHJ4*01 | 1034 | gnl|Fabrus|L11__IGKJ1*01 | 1087 |
| 745 | gnl|Fabrus|VH1-18__IGHD6-6*01__IGHJ1*01 | 728 | gnl|Fabrus|L11__IGKJ1*01 | 1087 |
| 746 | gnl|Fabrus|VH1-24__IGHD5-12*01__IGHJ4*01 | 735 | gnl|Fabrus|L11__IGKJ1*01 | 1087 |
| 747 | gnl|Fabrus|VH1-2__IGHD1-1*01__IGHJ3*01 | 729 | gnl|Fabrus|L11__IGKJ1*01 | 1087 |
| 748 | gnl|Fabrus|VH1-3__IGHD6-6*01__IGHJ1*01 | 743 | gnl|Fabrus|L11__IGKJ1*01 | 1087 |
| 749 | gnl|Fabrus|VH1-45__IGHD3-10*01__IGHJ4*01 | 748 | gnl|Fabrus|L11__IGKJ1*01 | 1087 |
| 750 | gnl|Fabrus|VH1-46__IGHD1-26*01__IGHJ4*01 | 754 | gnl|Fabrus|L11__IGKJ1*01 | 1087 |
| 751 | gnl|Fabrus|VH7-81__IGHD2-21*01__IGHJ6*01 | 1068 | gnl|Fabrus|L11__IGKJ1*01 | 1087 |
| 752 | gnl|Fabrus|VH2-70__IGHD3-9*01__IGHJ6*01 | 810 | gnl|Fabrus|L11__IGKJ1*01 | 1087 |
| 753 | gnl|Fabrus|VH1-58__IGHD3-10*01__IGHJ6*01 | 764 | gnl|Fabrus|L11__IGKJ1*01 | 1087 |
| 754 | gnl|Fabrus|VH7-81__IGHD2-21*01__IGHJ2*01 | 1067 | gnl|Fabrus|L11__IGKJ1*01 | 1087 |
| 755 | gnl|Fabrus|VH4-28__IGHD3-9*01__IGHJ6*01 | 1002 | gnl|Fabrus|L11__IGKJ1*01 | 1087 |
| 756 | gnl|Fabrus|VH4-31__IGHD2-15*01__IGHJ2*01 | 1008 | gnl|Fabrus|L11__IGKJ1*01 | 1087 |
| 757 | gnl|Fabrus|VH2-5__IGHD3-9*01__IGHJ6*01 | 803 | gnl|Fabrus|L11__IGKJ1*01 | 1087 |

TABLE 4-continued

Exemplary Paired Nucleic Acid Library

| | HEAVY CHAIN | SEQ ID NO | LIGHT CHAIN | SEQ ID NO |
|---|---|---|---|---|
| 758 | gnl\|Fabrus\|VH1-8__IGHD2-15*01__IGHJ6*01 | 783 | gnl\|Fabrus\|L11__IGKJ1*01 | 1087 |
| 759 | gnl\|Fabrus\|VH2-70__IGHD2-15*01__IGHJ2*01 | 808 | gnl\|Fabrus\|L11__IGKJ1*01 | 1087 |
| 760 | gnl\|Fabrus\|VH3-38__IGHD3-10*01__IGHJ4*01 | 907 | gnl\|Fabrus\|L11__IGKJ1*01 | 1087 |
| 761 | gnl\|Fabrus\|VH3-16__IGHD1-7*01__IGHJ6*01 | 838 | gnl\|Fabrus\|L11__IGKJ1*01 | 1087 |
| 762 | gnl\|Fabrus\|VH3-73__IGHD3-9*01__IGHJ6*01 | 974 | gnl\|Fabrus\|L11__IGKJ1*01 | 1087 |
| 763 | gnl\|Fabrus\|VH3-11__IGHD3-9*01__IGHJ6*01 | 816 | gnl\|Fabrus\|L11__IGKJ1*01 | 1087 |
| 764 | gnl\|Fabrus\|VH3-11__IGHD6-6*01__IGHJ1*01 | 820 | gnl\|Fabrus\|L11__IGKJ1*01 | 1087 |
| 765 | gnl\|Fabrus\|VH3-20__IGHD5-12*01__IGHJ4*01 | 852 | gnl\|Fabrus\|L11__IGKJ1*01 | 1087 |
| 766 | gnl\|Fabrus\|VH3-16__IGHD2-15*01__IGHJ2*01 | 839 | gnl\|Fabrus\|L11__IGKJ1*01 | 1087 |
| 767 | gnl\|Fabrus\|VH3-7__IGHD6-6*01__IGHJ1*01 | 960 | gnl\|Fabrus\|L11__IGKJ1*01 | 1087 |
| 768 | gnl\|Fabrus\|VH3-16__IGHD6-13*01__IGHJ4*01 | 844 | gnl\|Fabrus\|L11__IGKJ1*01 | 1087 |
| 769 | gnl\|Fabrus\|VH3-23__IGHD1-1*01__IGHJ4*01 | 863 | gnl\|Fabrus\|L12__IGKJ1*01 | 1088 |
| 770 | gnl\|Fabrus\|VH3-23__IGHD2-15*01__IGHJ4*01 | 866 | gnl\|Fabrus\|L12__IGKJ1*01 | 1088 |
| 771 | gnl\|Fabrus\|VH3-23__IGHD3-22*01__IGHJ4*01 | 870 | gnl\|Fabrus\|L12__IGKJ1*01 | 1088 |
| 772 | gnl\|Fabrus\|VH3-23__IGHD4-11*01__IGHJ4*01 | 872 | gnl\|Fabrus\|L12__IGKJ1*01 | 1088 |
| 773 | gnl\|Fabrus\|VH3-23__IGHD5-12*01__IGHJ4*01 | 874 | gnl\|Fabrus\|L12__IGKJ1*01 | 1088 |
| 774 | gnl\|Fabrus\|VH3-23__IGHD5-5*01__IGHJ4*01 | 876 | gnl\|Fabrus\|L12__IGKJ1*01 | 1088 |
| 775 | gnl\|Fabrus\|VH3-23__IGHD6-13*01__IGHJ4*01 | 877 | gnl\|Fabrus\|L12__IGKJ1*01 | 1088 |
| 776 | gnl\|Fabrus\|VH3-23__IGHD7-27*01__IGHJ4*01 | 880 | gnl\|Fabrus\|L12__IGKJ1*01 | 1088 |
| 777 | gnl\|Fabrus\|VH3-23__IGHD7-27*01__IGHJ6*01 | 881 | gnl\|Fabrus\|L12__IGKJ1*01 | 1088 |
| 778 | gnl\|Fabrus\|VH1-69__IGHD1-14*01__IGHJ4*01 | 770 | gnl\|Fabrus\|L12__IGKJ1*01 | 1088 |
| 779 | gnl\|Fabrus\|VH1-69__IGHD2-2*01__IGHJ4*01 | 771 | gnl\|Fabrus\|L12__IGKJ1*01 | 1088 |
| 780 | gnl\|Fabrus\|VH1-69__IGHD2-8*01__IGHJ6*01 | 772 | gnl\|Fabrus\|L12__IGKJ1*01 | 1088 |
| 781 | gnl\|Fabrus\|VH1-69__IGHD3-16*01__IGHJ4*01 | 773 | gnl\|Fabrus\|L12__IGKJ1*01 | 1088 |
| 782 | gnl\|Fabrus\|VH1-69__IGHD3-3*01__IGHJ4*01 | 774 | gnl\|Fabrus\|L12__IGKJ1*01 | 1088 |
| 783 | gnl\|Fabrus\|VH1-69__IGHD4-17*01__IGHJ4*01 | 776 | gnl\|Fabrus\|L12__IGKJ1*01 | 1088 |
| 784 | gnl\|Fabrus\|VH1-69__IGHD5-12*01__IGHJ4*01 | 777 | gnl\|Fabrus\|L12__IGKJ1*01 | 1088 |
| 785 | gnl\|Fabrus\|VH1-69__IGHD6-19*01__IGHJ4*01 | 779 | gnl\|Fabrus\|L12__IGKJ1*01 | 1088 |
| 786 | gnl\|Fabrus\|VH1-69__IGHD7-27*01__IGHJ4*01 | 781 | gnl\|Fabrus\|L12__IGKJ1*01 | 1088 |
| 787 | gnl\|Fabrus\|VH4-34__IGHD1-7*01__IGHJ4*01 | 1017 | gnl\|Fabrus\|L12__IGKJ1*01 | 1088 |
| 788 | gnl\|Fabrus\|VH4-34__IGHD2-2*01__IGHJ4*01 | 1018 | gnl\|Fabrus\|L12__IGKJ1*01 | 1088 |
| 789 | gnl\|Fabrus\|VH4-34__IGHD3-16*01__IGHJ4*01 | 1019 | gnl\|Fabrus\|L12__IGKJ1*01 | 1088 |
| 790 | gnl\|Fabrus\|VH4-34__IGHD4-17*01__IGHJ4*01 | 1021 | gnl\|Fabrus\|L12__IGKJ1*01 | 1088 |
| 791 | gnl\|Fabrus\|VH4-34__IGHD5-12*01__IGHJ4*01 | 1022 | gnl\|Fabrus\|L12__IGKJ1*01 | 1088 |
| 792 | gnl\|Fabrus\|VH4-34__IGHD6-13*01__IGHJ4*01 | 1023 | gnl\|Fabrus\|L12__IGKJ1*01 | 1088 |
| 793 | gnl\|Fabrus\|VH4-34__IGHD6-25*01__IGHJ6*01 | 1024 | gnl\|Fabrus\|L12__IGKJ1*01 | 1088 |
| 794 | gnl\|Fabrus\|VH4-34__IGHD7-27*01__IGHJ4*01 | 1026 | gnl\|Fabrus\|L12__IGKJ1*01 | 1088 |
| 795 | gnl\|Fabrus\|VH2-26__IGHD1-20*01__IGHJ4*01 | 789 | gnl\|Fabrus\|L12__IGKJ1*01 | 1088 |
| 796 | gnl\|Fabrus\|VH2-26__IGHD2-2*01__IGHJ4*01 | 791 | gnl\|Fabrus\|L12__IGKJ1*01 | 1088 |
| 797 | gnl\|Fabrus\|VH2-26__IGHD3-10*01__IGHJ4*01 | 792 | gnl\|Fabrus\|L12__IGKJ1*01 | 1088 |
| 798 | gnl\|Fabrus\|VH2-26__IGHD4-11*01__IGHJ4*01 | 794 | gnl\|Fabrus\|L12__IGKJ1*01 | 1088 |
| 799 | gnl\|Fabrus\|VH2-26__IGHD5-18*01__IGHJ4*01 | 796 | gnl\|Fabrus\|L12__IGKJ1*01 | 1088 |
| 800 | gnl\|Fabrus\|VH2-26__IGHD6-13*01__IGHJ4*01 | 797 | gnl\|Fabrus\|L12__IGKJ1*01 | 1088 |
| 801 | gnl\|Fabrus\|VH2-26__IGHD7-27*01__IGHJ4*01 | 798 | gnl\|Fabrus\|L12__IGKJ1*01 | 1088 |
| 802 | gnl\|Fabrus\|VH5-51__IGHD1-14*01__IGHJ4*01 | 1044 | gnl\|Fabrus\|L12__IGKJ1*01 | 1088 |
| 803 | gnl\|Fabrus\|VH5-51__IGHD2-8*01__IGHJ4*01 | 1046 | gnl\|Fabrus\|L12__IGKJ1*01 | 1088 |
| 804 | gnl\|Fabrus\|VH5-51__IGHD3-3*01__IGHJ4*01 | 1048 | gnl\|Fabrus\|L12__IGKJ1*01 | 1088 |
| 805 | gnl\|Fabrus\|VH5-51__IGHD4-17*01__IGHJ4*01 | 1049 | gnl\|Fabrus\|L12__IGKJ1*01 | 1088 |
| 806 | gnl\|Fabrus\|VH5-51__IGHD5-18*01__IGHJ4*01 | 1050 | gnl\|Fabrus\|L12__IGKJ1*01 | 1088 |
| 807 | gnl\|Fabrus\|VH5-51__IGHD5-18*01__IGHJ4*01 | 1051 | gnl\|Fabrus\|L12__IGKJ1*01 | 1088 |
| 808 | gnl\|Fabrus\|VH5-51__IGHD6-25*01__IGHJ4*01 | 1052 | gnl\|Fabrus\|L12__IGKJ1*01 | 1088 |
| 809 | gnl\|Fabrus\|VH5-51__IGHD7-27*01__IGHJ4*01 | 1053 | gnl\|Fabrus\|L12__IGKJ1*01 | 1088 |
| 810 | gnl\|Fabrus\|VH6-1__IGHD1-1*01__IGHJ4*01 | 1054 | gnl\|Fabrus\|L12__IGKJ1*01 | 1088 |
| 811 | gnl\|Fabrus\|VH6-1__IGHD2-15*01__IGHJ4*01 | 1056 | gnl\|Fabrus\|L12__IGKJ1*01 | 1088 |
| 812 | gnl\|Fabrus\|VH6-1__IGHD3-3*01__IGHJ4*01 | 1059 | gnl\|Fabrus\|L12__IGKJ1*01 | 1088 |
| 813 | gnl\|Fabrus\|VH6-1__IGHD4-23*01__IGHJ4*01 | 1061 | gnl\|Fabrus\|L12__IGKJ1*01 | 1088 |
| 814 | gnl\|Fabrus\|VH6-1__IGHD4-11*01__IGHJ6*01 | 1060 | gnl\|Fabrus\|L12__IGKJ1*01 | 1088 |
| 815 | gnl\|Fabrus\|VH6-1__IGHD5-5*01__IGHJ4*01 | 1062 | gnl\|Fabrus\|L12__IGKJ1*01 | 1088 |
| 816 | gnl\|Fabrus\|VH6-1__IGHD6-13*01__IGHJ4*01 | 1063 | gnl\|Fabrus\|L12__IGKJ1*01 | 1088 |
| 817 | gnl\|Fabrus\|VH6-1__IGHD6-25*01__IGHJ6*01 | 1064 | gnl\|Fabrus\|L12__IGKJ1*01 | 1088 |
| 818 | gnl\|Fabrus\|VH6-1__IGHD7-27*01__IGHJ4*01 | 1065 | gnl\|Fabrus\|L12__IGKJ1*01 | 1088 |
| 819 | gnl\|Fabrus\|VH4-59__IGHD6-25*01__IGHJ3*01 | 1043 | gnl\|Fabrus\|L12__IGKJ1*01 | 1088 |
| 820 | gnl\|Fabrus\|VH3-48__IGHD6-6*01__IGHJ1*01 | 923 | gnl\|Fabrus\|L12__IGKJ1*01 | 1088 |
| 821 | gnl\|Fabrus\|VH3-30__IGHD6-6*01__IGHJ1*01 | 893 | gnl\|Fabrus\|L12__IGKJ1*01 | 1088 |
| 822 | gnl\|Fabrus\|VH3-66__IGHD6-6*01__IGHJ1*01 | 949 | gnl\|Fabrus\|L12__IGKJ1*01 | 1088 |
| 823 | gnl\|Fabrus\|VH3-53__IGHD5-5*01__IGHJ4*01 | 938 | gnl\|Fabrus\|L12__IGKJ1*01 | 1088 |
| 824 | gnl\|Fabrus\|VH2-5__IGHD5-12*01__IGHJ4*01 | 804 | gnl\|Fabrus\|L12__IGKJ1*01 | 1088 |
| 825 | gnl\|Fabrus\|VH2-70__IGHD5-12*01__IGHJ4*01 | 811 | gnl\|Fabrus\|L12__IGKJ1*01 | 1088 |
| 826 | gnl\|Fabrus\|VH3-15__IGHD5-12*01__IGHJ4*01 | 835 | gnl\|Fabrus\|L12__IGKJ1*01 | 1088 |
| 827 | gnl\|Fabrus\|VH3-15__IGHD3-10*01__IGHJ4*01 | 833 | gnl\|Fabrus\|L12__IGKJ1*01 | 1088 |
| 828 | gnl\|Fabrus\|VH3-49__IGHD5-18*01__IGHJ4*01 | 930 | gnl\|Fabrus\|L12__IGKJ1*01 | 1088 |
| 829 | gnl\|Fabrus\|VH3-49__IGHD6-13*01__IGHJ4*01 | 931 | gnl\|Fabrus\|L12__IGKJ1*01 | 1088 |
| 830 | gnl\|Fabrus\|VH3-72__IGHD5-18*01__IGHJ4*01 | 967 | gnl\|Fabrus\|L12__IGKJ1*01 | 1088 |
| 831 | gnl\|Fabrus\|VH3-72__IGHD6-6*01__IGHJ1*01 | 969 | gnl\|Fabrus\|L12__IGKJ1*01 | 1088 |

TABLE 4-continued

Exemplary Paired Nucleic Acid Library

| | HEAVY CHAIN | SEQ ID NO | LIGHT CHAIN | SEQ ID NO |
|---|---|---|---|---|
| 832 | gnl\|Fabrus\|VH3-73__IGHD5-12*01__IGHJ4*01 | 977 | gnl\|Fabrus\|L12__IGKJ1*01 | 1088 |
| 833 | gnl\|Fabrus\|VH3-73__IGHD4-23*01__IGHJ5*01 | 976 | gnl\|Fabrus\|L12__IGKJ1*01 | 1088 |
| 834 | gnl\|Fabrus\|VH3-43__IGHD3-22*01__IGHJ4*01 | 918 | gnl\|Fabrus\|L12__IGKJ1*01 | 1088 |
| 835 | gnl\|Fabrus\|VH3-43__IGHD6-13*01__IGHJ4*01 | 921 | gnl\|Fabrus\|L12__IGKJ1*01 | 1088 |
| 836 | gnl\|Fabrus\|VH3-9__IGHD3-22*01__IGHJ4*01 | 992 | gnl\|Fabrus\|L12__IGKJ1*01 | 1088 |
| 837 | gnl\|Fabrus\|VH3-9__IGHD1-7*01__IGHJ5*01 | 989 | gnl\|Fabrus\|L12__IGKJ1*01 | 1088 |
| 838 | gnl\|Fabrus\|VH3-9__IGHD6-13*01__IGHJ4*01 | 995 | gnl\|Fabrus\|L12__IGKJ1*01 | 1088 |
| 839 | gnl\|Fabrus\|VH4-39__IGHD3-10*01__IGHJ4*01 | 1030 | gnl\|Fabrus\|L12__IGKJ1*01 | 1088 |
| 840 | gnl\|Fabrus\|VH4-39__IGHD5-12*01__IGHJ4*01 | 1034 | gnl\|Fabrus\|L12__IGKJ1*01 | 1088 |
| 841 | gnl\|Fabrus\|VH1-18__IGHD6-6*01__IGHJ1*01 | 728 | gnl\|Fabrus\|L12__IGKJ1*01 | 1088 |
| 842 | gnl\|Fabrus\|VH1-24__IGHD5-12*01__IGHJ4*01 | 735 | gnl\|Fabrus\|L12__IGKJ1*01 | 1088 |
| 843 | gnl\|Fabrus\|VH1-2__IGHD1-1*01__IGHJ3*01 | 729 | gnl\|Fabrus\|L12__IGKJ1*01 | 1088 |
| 844 | gnl\|Fabrus\|VH1-3__IGHD6-6*01__IGHJ1*01 | 743 | gnl\|Fabrus\|L12__IGKJ1*01 | 1088 |
| 845 | gnl\|Fabrus\|VH1-45__IGHD3-10*01__IGHJ4*01 | 748 | gnl\|Fabrus\|L12__IGKJ1*01 | 1088 |
| 846 | gnl\|Fabrus\|VH1-46__IGHD1-26*01__IGHJ4*01 | 754 | gnl\|Fabrus\|L12__IGKJ1*01 | 1088 |
| 847 | gnl\|Fabrus\|VH7-81__IGHD2-21*01__IGHJ6*01 | 1068 | gnl\|Fabrus\|L12__IGKJ1*01 | 1088 |
| 848 | gnl\|Fabrus\|VH2-70__IGHD3-9*01__IGHJ6*01 | 810 | gnl\|Fabrus\|L12__IGKJ1*01 | 1088 |
| 849 | gnl\|Fabrus\|VH1-58__IGHD3-10*01__IGHJ6*01 | 764 | gnl\|Fabrus\|L12__IGKJ1*01 | 1088 |
| 850 | gnl\|Fabrus\|VH7-81__IGHD2-21*01__IGHJ2*01 | 1067 | gnl\|Fabrus\|L12__IGKJ1*01 | 1088 |
| 851 | gnl\|Fabrus\|VH4-28__IGHD3-9*01__IGHJ6*01 | 1002 | gnl\|Fabrus\|L12__IGKJ1*01 | 1088 |
| 852 | gnl\|Fabrus\|VH4-31__IGHD2-15*01__IGHJ2*01 | 1008 | gnl\|Fabrus\|L12__IGKJ1*01 | 1088 |
| 853 | gnl\|Fabrus\|VH2-5__IGHD3-9*01__IGHJ6*01 | 803 | gnl\|Fabrus\|L12__IGKJ1*01 | 1088 |
| 854 | gnl\|Fabrus\|VH1-8__IGHD2-15*01__IGHJ6*01 | 783 | gnl\|Fabrus\|L12__IGKJ1*01 | 1088 |
| 855 | gnl\|Fabrus\|VH2-70__IGHD2-15*01__IGHJ2*01 | 808 | gnl\|Fabrus\|L12__IGKJ1*01 | 1088 |
| 856 | gnl\|Fabrus\|VH3-38__IGHD3-10*01__IGHJ4*01 | 907 | gnl\|Fabrus\|L12__IGKJ1*01 | 1088 |
| 857 | gnl\|Fabrus\|VH3-16__IGHD1-7*01__IGHJ6*01 | 838 | gnl\|Fabrus\|L12__IGKJ1*01 | 1088 |
| 858 | gnl\|Fabrus\|VH3-73__IGHD3-9*01__IGHJ6*01 | 974 | gnl\|Fabrus\|L12__IGKJ1*01 | 1088 |
| 859 | gnl\|Fabrus\|VH3-11__IGHD3-9*01__IGHJ6*01 | 816 | gnl\|Fabrus\|L12__IGKJ1*01 | 1088 |
| 860 | gnl\|Fabrus\|VH3-11__IGHD6-6*01__IGHJ1*01 | 820 | gnl\|Fabrus\|L12__IGKJ1*01 | 1088 |
| 861 | gnl\|Fabrus\|VH3-20__IGHD5-12*01__IGHJ4*01 | 852 | gnl\|Fabrus\|L12__IGKJ1*01 | 1088 |
| 862 | gnl\|Fabrus\|VH3-16__IGHD2-15*01__IGHJ2*01 | 839 | gnl\|Fabrus\|L12__IGKJ1*01 | 1088 |
| 863 | gnl\|Fabrus\|VH3-7__IGHD6-6*01__IGHJ1*01 | 960 | gnl\|Fabrus\|L12__IGKJ1*01 | 1088 |
| 864 | gnl\|Fabrus\|VH3-16__IGHD6-13*01__IGHJ4*01 | 844 | gnl\|Fabrus\|L12__IGKJ1*01 | 1088 |
| 865 | gnl\|Fabrus\|VH3-23__IGHD1-1*01__IGHJ4*01 | 863 | gnl\|Fabrus\|O1__IGKJ1*01 | 1100 |
| 866 | gnl\|Fabrus\|VH3-23__IGHD2-15*01__IGHJ4*01 | 866 | gnl\|Fabrus\|O1__IGKJ1*01 | 1100 |
| 867 | gnl\|Fabrus\|VH3-23__IGHD3-22*01__IGHJ4*01 | 870 | gnl\|Fabrus\|O1__IGKJ1*01 | 1100 |
| 868 | gnl\|Fabrus\|VH3-23__IGHD4-11*01__IGHJ4*01 | 872 | gnl\|Fabrus\|O1__IGKJ1*01 | 1100 |
| 869 | gnl\|Fabrus\|VH3-23__IGHD5-12*01__IGHJ4*01 | 874 | gnl\|Fabrus\|O1__IGKJ1*01 | 1100 |
| 870 | gnl\|Fabrus\|VH3-23__IGHD5-5*01__IGHJ4*01 | 876 | gnl\|Fabrus\|O1__IGKJ1*01 | 1100 |
| 871 | gnl\|Fabrus\|VH3-23__IGHD6-13*01__IGHJ4*01 | 877 | gnl\|Fabrus\|O1__IGKJ1*01 | 1100 |
| 872 | gnl\|Fabrus\|VH3-23__IGHD7-27*01__IGHJ4*01 | 880 | gnl\|Fabrus\|O1__IGKJ1*01 | 1100 |
| 873 | gnl\|Fabrus\|VH3-23__IGHD7-27*01__IGHJ6*01 | 881 | gnl\|Fabrus\|O1__IGKJ1*01 | 1100 |
| 874 | gnl\|Fabrus\|VH1-69__IGHD1-14*01__IGHJ4*01 | 770 | gnl\|Fabrus\|O1__IGKJ1*01 | 1100 |
| 875 | gnl\|Fabrus\|VH1-69__IGHD2-2*01__IGHJ4*01 | 771 | gnl\|Fabrus\|O1__IGKJ1*01 | 1100 |
| 876 | gnl\|Fabrus\|VH1-69__IGHD2-8*01__IGHJ6*01 | 772 | gnl\|Fabrus\|O1__IGKJ1*01 | 1100 |
| 877 | gnl\|Fabrus\|VH1-69__IGHD3-16*01__IGHJ4*01 | 773 | gnl\|Fabrus\|O1__IGKJ1*01 | 1100 |
| 878 | gnl\|Fabrus\|VH1-69__IGHD3-3*01__IGHJ4*01 | 774 | gnl\|Fabrus\|O1__IGKJ1*01 | 1100 |
| 879 | gnl\|Fabrus\|VH1-69__IGHD4-17*01__IGHJ4*01 | 776 | gnl\|Fabrus\|O1__IGKJ1*01 | 1100 |
| 880 | gnl\|Fabrus\|VH1-69__IGHD5-12*01__IGHJ4*01 | 777 | gnl\|Fabrus\|O1__IGKJ1*01 | 1100 |
| 881 | gnl\|Fabrus\|VH1-69__IGHD6-19*01__IGHJ4*01 | 779 | gnl\|Fabrus\|O1__IGKJ1*01 | 1100 |
| 882 | gnl\|Fabrus\|VH1-69__IGHD7-27*01__IGHJ4*01 | 781 | gnl\|Fabrus\|O1__IGKJ1*01 | 1100 |
| 883 | gnl\|Fabrus\|VH4-34__IGHD1-7*01__IGHJ4*01 | 1017 | gnl\|Fabrus\|O1__IGKJ1*01 | 1100 |
| 884 | gnl\|Fabrus\|VH4-34__IGHD2-2*01__IGHJ4*01 | 1018 | gnl\|Fabrus\|O1__IGKJ1*01 | 1100 |
| 885 | gnl\|Fabrus\|VH4-34__IGHD3-16*01__IGHJ4*01 | 1019 | gnl\|Fabrus\|O1__IGKJ1*01 | 1100 |
| 886 | gnl\|Fabrus\|VH4-34__IGHD4-17*01__IGHJ4*01 | 1021 | gnl\|Fabrus\|O1__IGKJ1*01 | 1100 |
| 887 | gnl\|Fabrus\|VH4-34__IGHD5-12*01__IGHJ4*01 | 1022 | gnl\|Fabrus\|O1__IGKJ1*01 | 1100 |
| 888 | gnl\|Fabrus\|VH4-34__IGHD6-13*01__IGHJ4*01 | 1023 | gnl\|Fabrus\|O1__IGKJ1*01 | 1100 |
| 889 | gnl\|Fabrus\|VH4-34__IGHD6-25*01__IGHJ6*01 | 1024 | gnl\|Fabrus\|O1__IGKJ1*01 | 1100 |
| 890 | gnl\|Fabrus\|VH4-34__IGHD7-27*01__IGHJ4*01 | 1026 | gnl\|Fabrus\|O1__IGKJ1*01 | 1100 |
| 891 | gnl\|Fabrus\|VH2-26__IGHD1-20*01__IGHJ4*01 | 789 | gnl\|Fabrus\|O1__IGKJ1*01 | 1100 |
| 892 | gnl\|Fabrus\|VH2-26__IGHD2-2*01__IGHJ4*01 | 791 | gnl\|Fabrus\|O1__IGKJ1*01 | 1100 |
| 893 | gnl\|Fabrus\|VH2-26__IGHD3-10*01__IGHJ4*01 | 792 | gnl\|Fabrus\|O1__IGKJ1*01 | 1100 |
| 894 | gnl\|Fabrus\|VH2-26__IGHD4-11*01__IGHJ4*01 | 794 | gnl\|Fabrus\|O1__IGKJ1*01 | 1100 |
| 895 | gnl\|Fabrus\|VH2-26__IGHD5-18*01__IGHJ4*01 | 796 | gnl\|Fabrus\|O1__IGKJ1*01 | 1100 |
| 896 | gnl\|Fabrus\|VH2-26__IGHD6-13*01__IGHJ4*01 | 797 | gnl\|Fabrus\|O1__IGKJ1*01 | 1100 |
| 897 | gnl\|Fabrus\|VH2-26__IGHD7-27*01__IGHJ4*01 | 798 | gnl\|Fabrus\|O1__IGKJ1*01 | 1100 |
| 898 | gnl\|Fabrus\|VH5-51__IGHD1-14*01__IGHJ4*01 | 1044 | gnl\|Fabrus\|O1__IGKJ1*01 | 1100 |
| 899 | gnl\|Fabrus\|VH5-51__IGHD2-8*01__IGHJ4*01 | 1046 | gnl\|Fabrus\|O1__IGKJ1*01 | 1100 |
| 900 | gnl\|Fabrus\|VH5-51__IGHD3-3*01__IGHJ4*01 | 1048 | gnl\|Fabrus\|O1__IGKJ1*01 | 1100 |
| 901 | gnl\|Fabrus\|VH5-51__IGHD4-17*01__IGHJ4*01 | 1049 | gnl\|Fabrus\|O1__IGKJ1*01 | 1100 |
| 902 | gnl\|Fabrus\|VH5-51__IGHD5-18*01__IGHJ4*01 | 1050 | gnl\|Fabrus\|O1__IGKJ1*01 | 1100 |
| 903 | gnl\|Fabrus\|VH5-51__IGHD5-18*01__IGHJ4*01 | 1051 | gnl\|Fabrus\|O1__IGKJ1*01 | 1100 |
| 904 | gnl\|Fabrus\|VH5-51__IGHD6-25*01__IGHJ4*01 | 1052 | gnl\|Fabrus\|O1__IGKJ1*01 | 1100 |
| 905 | gnl\|Fabrus\|VH5-51__IGHD7-27*01__IGHJ4*01 | 1053 | gnl\|Fabrus\|O1__IGKJ1*01 | 1100 |

TABLE 4-continued

Exemplary Paired Nucleic Acid Library

| | HEAVY CHAIN | SEQ ID NO | LIGHT CHAIN | SEQ ID NO |
|---|---|---|---|---|
| 906 | gnl|Fabrus|VH6-1__IGHD1-1*01__IGHJ4*01 | 1054 | gnl|Fabrus|O1__IGKJ1*01 | 1100 |
| 907 | gnl|Fabrus|VH6-1__IGHD2-15*01__IGHJ4*01 | 1056 | gnl|Fabrus|O1__IGKJ1*01 | 1100 |
| 908 | gnl|Fabrus|VH6-1__IGHD3-3*01__IGHJ4*01 | 1059 | gnl|Fabrus|O1__IGKJ1*01 | 1100 |
| 909 | gnl|Fabrus|VH6-1__IGHD4-23*01__IGHJ4*01 | 1061 | gnl|Fabrus|O1__IGKJ1*01 | 1100 |
| 910 | gnl|Fabrus|VH6-1__IGHD4-11*01__IGHJ6*01 | 1060 | gnl|Fabrus|O1__IGKJ1*01 | 1100 |
| 911 | gnl|Fabrus|VH6-1__IGHD5-5*01__IGHJ4*01 | 1062 | gnl|Fabrus|O1__IGKJ1*01 | 1100 |
| 912 | gnl|Fabrus|VH6-1__IGHD6-13*01__IGHJ4*01 | 1063 | gnl|Fabrus|O1__IGKJ1*01 | 1100 |
| 913 | gnl|Fabrus|VH6-1__IGHD6-25*01__IGHJ6*01 | 1064 | gnl|Fabrus|O1__IGKJ1*01 | 1100 |
| 914 | gnl|Fabrus|VH6-1__IGHD7-27*01__IGHJ4*01 | 1065 | gnl|Fabrus|O1__IGKJ1*01 | 1100 |
| 915 | gnl|Fabrus|VH4-59__IGHD6-25*01__IGHJ3*01 | 1043 | gnl|Fabrus|O1__IGKJ1*01 | 1100 |
| 916 | gnl|Fabrus|VH3-48__IGHD6-6*01__IGHJ1*01 | 923 | gnl|Fabrus|O1__IGKJ1*01 | 1100 |
| 917 | gnl|Fabrus|VH3-30__IGHD6-6*01__IGHJ1*01 | 893 | gnl|Fabrus|O1__IGKJ1*01 | 1100 |
| 918 | gnl|Fabrus|VH3-66__IGHD6-6*01__IGHJ1*01 | 949 | gnl|Fabrus|O1__IGKJ1*01 | 1100 |
| 919 | gnl|Fabrus|VH3-53__IGHD5-5*01__IGHJ4*01 | 938 | gnl|Fabrus|O1__IGKJ1*01 | 1100 |
| 920 | gnl|Fabrus|VH2-5__IGHD5-12*01__IGHJ4*01 | 804 | gnl|Fabrus|O1__IGKJ1*01 | 1100 |
| 921 | gnl|Fabrus|VH2-70__IGHD5-12*01__IGHJ4*01 | 811 | gnl|Fabrus|O1__IGKJ1*01 | 1100 |
| 922 | gnl|Fabrus|VH3-15__IGHD5-12*01__IGHJ4*01 | 835 | gnl|Fabrus|O1__IGKJ1*01 | 1100 |
| 923 | gnl|Fabrus|VH3-15__IGHD3-10*01__IGHJ4*01 | 833 | gnl|Fabrus|O1__IGKJ1*01 | 1100 |
| 924 | gnl|Fabrus|VH3-49__IGHD5-18*01__IGHJ4*01 | 930 | gnl|Fabrus|O1__IGKJ1*01 | 1100 |
| 925 | gnl|Fabrus|VH3-49__IGHD6-13*01__IGHJ4*01 | 931 | gnl|Fabrus|O1__IGKJ1*01 | 1100 |
| 926 | gnl|Fabrus|VH3-72__IGHD5-18*01__IGHJ4*01 | 967 | gnl|Fabrus|O1__IGKJ1*01 | 1100 |
| 927 | gnl|Fabrus|VH3-72__IGHD6-6*01__IGHJ1*01 | 969 | gnl|Fabrus|O1__IGKJ1*01 | 1100 |
| 928 | gnl|Fabrus|VH3-73__IGHD5-12*01__IGHJ4*01 | 977 | gnl|Fabrus|O1__IGKJ1*01 | 1100 |
| 929 | gnl|Fabrus|VH3-73__IGHD4-23*01__IGHJ5*01 | 976 | gnl|Fabrus|O1__IGKJ1*01 | 1100 |
| 930 | gnl|Fabrus|VH3-43__IGHD3-22*01__IGHJ4*01 | 918 | gnl|Fabrus|O1__IGKJ1*01 | 1100 |
| 931 | gnl|Fabrus|VH3-43__IGHD6-13*01__IGHJ4*01 | 921 | gnl|Fabrus|O1__IGKJ1*01 | 1100 |
| 932 | gnl|Fabrus|VH3-9__IGHD3-22*01__IGHJ4*01 | 992 | gnl|Fabrus|O1__IGKJ1*01 | 1100 |
| 933 | gnl|Fabrus|VH3-9__IGHD1-7*01__IGHJ5*01 | 989 | gnl|Fabrus|O1__IGKJ1*01 | 1100 |
| 934 | gnl|Fabrus|VH3-9__IGHD6-13*01__IGHJ4*01 | 995 | gnl|Fabrus|O1__IGKJ1*01 | 1100 |
| 935 | gnl|Fabrus|VH4-39__IGHD3-10*01__IGHJ4*01 | 1030 | gnl|Fabrus|O1__IGKJ1*01 | 1100 |
| 936 | gnl|Fabrus|VH4-39__IGHD5-12*01__IGHJ4*01 | 1034 | gnl|Fabrus|O1__IGKJ1*01 | 1100 |
| 937 | gnl|Fabrus|VH1-18__IGHD6-6*01__IGHJ1*01 | 728 | gnl|Fabrus|O1__IGKJ1*01 | 1100 |
| 938 | gnl|Fabrus|VH1-24__IGHD5-12*01__IGHJ4*01 | 735 | gnl|Fabrus|O1__IGKJ1*01 | 1100 |
| 939 | gnl|Fabrus|VH1-2__IGHD1-1*01__IGHJ3*01 | 729 | gnl|Fabrus|O1__IGKJ1*01 | 1100 |
| 940 | gnl|Fabrus|VH1-3__IGHD6-6*01__IGHJ1*01 | 743 | gnl|Fabrus|O1__IGKJ1*01 | 1100 |
| 941 | gnl|Fabrus|VH1-45__IGHD3-10*01__IGHJ4*01 | 748 | gnl|Fabrus|O1__IGKJ1*01 | 1100 |
| 942 | gnl|Fabrus|VH1-46__IGHD1-26*01__IGHJ4*01 | 754 | gnl|Fabrus|O1__IGKJ1*01 | 1100 |
| 943 | gnl|Fabrus|VH7-81__IGHD2-21*01__IGHJ6*01 | 1068 | gnl|Fabrus|O1__IGKJ1*01 | 1100 |
| 944 | gnl|Fabrus|VH2-70__IGHD3-9*01__IGHJ6*01 | 810 | gnl|Fabrus|O1__IGKJ1*01 | 1100 |
| 945 | gnl|Fabrus|VH1-58__IGHD3-10*01__IGHJ6*01 | 764 | gnl|Fabrus|O1__IGKJ1*01 | 1100 |
| 946 | gnl|Fabrus|VH7-81__IGHD2-21*01__IGHJ2*01 | 1067 | gnl|Fabrus|O1__IGKJ1*01 | 1100 |
| 947 | gnl|Fabrus|VH4-28__IGHD3-9*01__IGHJ6*01 | 1002 | gnl|Fabrus|O1__IGKJ1*01 | 1100 |
| 948 | gnl|Fabrus|VH4-31__IGHD2-15*01__IGHJ2*01 | 1008 | gnl|Fabrus|O1__IGKJ1*01 | 1100 |
| 949 | gnl|Fabrus|VH2-5__IGHD3-9*01__IGHJ6*01 | 803 | gnl|Fabrus|O1__IGKJ1*01 | 1100 |
| 950 | gnl|Fabrus|VH1-8__IGHD2-15*01__IGHJ6*01 | 783 | gnl|Fabrus|O1__IGKJ1*01 | 1100 |
| 951 | gnl|Fabrus|VH2-70__IGHD2-15*01__IGHJ2*01 | 808 | gnl|Fabrus|O1__IGKJ1*01 | 1100 |
| 952 | gnl|Fabrus|VH3-38__IGHD3-10*01__IGHJ4*01 | 907 | gnl|Fabrus|O1__IGKJ1*01 | 1100 |
| 953 | gnl|Fabrus|VH3-16__IGHD1-7*01__IGHJ6*01 | 838 | gnl|Fabrus|O1__IGKJ1*01 | 1100 |
| 954 | gnl|Fabrus|VH3-73__IGHD3-9*01__IGHJ6*01 | 974 | gnl|Fabrus|O1__IGKJ1*01 | 1100 |
| 955 | gnl|Fabrus|VH3-11__IGHD3-9*01__IGHJ6*01 | 816 | gnl|Fabrus|O1__IGKJ1*01 | 1100 |
| 956 | gnl|Fabrus|VH3-11__IGHD6-6*01__IGHJ1*01 | 820 | gnl|Fabrus|O1__IGKJ1*01 | 1100 |
| 957 | gnl|Fabrus|VH3-20__IGHD5-12*01__IGHJ4*01 | 852 | gnl|Fabrus|O1__IGKJ1*01 | 1100 |
| 958 | gnl|Fabrus|VH3-16__IGHD2-15*01__IGHJ2*01 | 839 | gnl|Fabrus|O1__IGKJ1*01 | 1100 |
| 959 | gnl|Fabrus|VH3-7__IGHD6-6*01__IGHJ1*01 | 960 | gnl|Fabrus|O1__IGKJ1*01 | 1100 |
| 960 | gnl|Fabrus|VH3-16__IGHD6-13*01__IGHJ4*01 | 844 | gnl|Fabrus|O1__IGKJ1*01 | 1100 |
| 961 | gnl|Fabrus|VH3-23__IGHD1-1*01__IGHJ4*01 | 863 | gnl|Fabrus|L25__IGKJ3*01 | 1094 |
| 962 | gnl|Fabrus|VH3-23__IGHD2-15*01__IGHJ4*01 | 866 | gnl|Fabrus|L25__IGKJ3*01 | 1094 |
| 963 | gnl|Fabrus|VH3-23__IGHD3-22*01__IGHJ4*01 | 870 | gnl|Fabrus|L25__IGKJ3*01 | 1094 |
| 964 | gnl|Fabrus|VH3-23__IGHD4-11*01__IGHJ4*01 | 872 | gnl|Fabrus|L25__IGKJ3*01 | 1094 |
| 965 | gnl|Fabrus|VH3-23__IGHD5-12*01__IGHJ4*01 | 874 | gnl|Fabrus|L25__IGKJ3*01 | 1094 |
| 966 | gnl|Fabrus|VH3-23__IGHD5-5*01__IGHJ4*01 | 876 | gnl|Fabrus|L25__IGKJ3*01 | 1094 |
| 967 | gnl|Fabrus|VH3-23__IGHD6-13*01__IGHJ4*01 | 877 | gnl|Fabrus|L25__IGKJ3*01 | 1094 |
| 968 | gnl|Fabrus|VH3-23__IGHD7-27*01__IGHJ4*01 | 880 | gnl|Fabrus|L25__IGKJ3*01 | 1094 |
| 969 | gnl|Fabrus|VH3-23__IGHD7-27*01__IGHJ6*01 | 881 | gnl|Fabrus|L25__IGKJ3*01 | 1094 |
| 970 | gnl|Fabrus|VH1-69__IGHD1-14*01__IGHJ4*01 | 770 | gnl|Fabrus|L25__IGKJ3*01 | 1094 |
| 971 | gnl|Fabrus|VH1-69__IGHD2-2*01__IGHJ4*01 | 771 | gnl|Fabrus|L25__IGKJ3*01 | 1094 |
| 972 | gnl|Fabrus|VH1-69__IGHD2-8*01__IGHJ6*01 | 772 | gnl|Fabrus|L25__IGKJ3*01 | 1094 |
| 973 | gnl|Fabrus|VH1-69__IGHD3-16*01__IGHJ4*01 | 773 | gnl|Fabrus|L25__IGKJ3*01 | 1094 |
| 974 | gnl|Fabrus|VH1-69__IGHD3-3*01__IGHJ4*01 | 774 | gnl|Fabrus|L25__IGKJ3*01 | 1094 |
| 975 | gnl|Fabrus|VH1-69__IGHD4-17*01__IGHJ4*01 | 776 | gnl|Fabrus|L25__IGKJ3*01 | 1094 |
| 976 | gnl|Fabrus|VH1-69__IGHD5-12*01__IGHJ4*01 | 777 | gnl|Fabrus|L25__IGKJ3*01 | 1094 |
| 977 | gnl|Fabrus|VH1-69__IGHD6-19*01__IGHJ4*01 | 779 | gnl|Fabrus|L25__IGKJ3*01 | 1094 |
| 978 | gnl|Fabrus|VH1-69__IGHD7-27*01__IGHJ4*01 | 781 | gnl|Fabrus|L25__IGKJ3*01 | 1094 |
| 979 | gnl|Fabrus|VH4-34__IGHD1-7*01__IGHJ4*01 | 1017 | gnl|Fabrus|L25__IGKJ3*01 | 1094 |

TABLE 4-continued

Exemplary Paired Nucleic Acid Library

| | HEAVY CHAIN | SEQ ID NO | LIGHT CHAIN | SEQ ID NO |
|---|---|---|---|---|
| 980 | gnl\|Fabrus\|VH4-34__IGHD2-2*01__IGHJ4*01 | 1018 | gnl\|Fabrus\|L25__IGKJ3*01 | 1094 |
| 981 | gnl\|Fabrus\|VH4-34__IGHD3-16*01__IGHJ4*01 | 1019 | gnl\|Fabrus\|L25__IGKJ3*01 | 1094 |
| 982 | gnl\|Fabrus\|VH4-34__IGHD4-17*01__IGHJ4*01 | 1021 | gnl\|Fabrus\|L25__IGKJ3*01 | 1094 |
| 983 | gnl\|Fabrus\|VH4-34__IGHD5-12*01__IGHJ4*01 | 1022 | gnl\|Fabrus\|L25__IGKJ3*01 | 1094 |
| 984 | gnl\|Fabrus\|VH4-34__IGHD6-13*01__IGHJ4*01 | 1023 | gnl\|Fabrus\|L25__IGKJ3*01 | 1094 |
| 985 | gnl\|Fabrus\|VH4-34__IGHD6-25*01__IGHJ6*01 | 1024 | gnl\|Fabrus\|L25__IGKJ3*01 | 1094 |
| 986 | gnl\|Fabrus\|VH4-34__IGHD7-27*01__IGHJ4*01 | 1026 | gnl\|Fabrus\|L25__IGKJ3*01 | 1094 |
| 987 | gnl\|Fabrus\|VH2-26__IGHD1-20*01__IGHJ4*01 | 789 | gnl\|Fabrus\|L25__IGKJ3*01 | 1094 |
| 988 | gnl\|Fabrus\|VH2-26__IGHD2-2*01__IGHJ4*01 | 791 | gnl\|Fabrus\|L25__IGKJ3*01 | 1094 |
| 989 | gnl\|Fabrus\|VH2-26__IGHD3-10*01__IGHJ4*01 | 792 | gnl\|Fabrus\|L25__IGKJ3*01 | 1094 |
| 990 | gnl\|Fabrus\|VH2-26__IGHD4-11*01__IGHJ4*01 | 794 | gnl\|Fabrus\|L25__IGKJ3*01 | 1094 |
| 991 | gnl\|Fabrus\|VH2-26__IGHD5-18*01__IGHJ4*01 | 796 | gnl\|Fabrus\|L25__IGKJ3*01 | 1094 |
| 992 | gnl\|Fabrus\|VH2-26__IGHD6-13*01__IGHJ4*01 | 797 | gnl\|Fabrus\|L25__IGKJ3*01 | 1094 |
| 993 | gnl\|Fabrus\|VH2-26__IGHD7-27*01__IGHJ4*01 | 798 | gnl\|Fabrus\|L25__IGKJ3*01 | 1094 |
| 994 | gnl\|Fabrus\|VH5-51__IGHD1-14*01__IGHJ4*01 | 1044 | gnl\|Fabrus\|L25__IGKJ3*01 | 1094 |
| 995 | gnl\|Fabrus\|VH5-51__IGHD2-8*01__IGHJ4*01 | 1046 | gnl\|Fabrus\|L25__IGKJ3*01 | 1094 |
| 996 | gnl\|Fabrus\|VH5-51__IGHD3-3*01__IGHJ4*01 | 1048 | gnl\|Fabrus\|L25__IGKJ3*01 | 1094 |
| 997 | gnl\|Fabrus\|VH5-51__IGHD4-17*01__IGHJ4*01 | 1049 | gnl\|Fabrus\|L25__IGKJ3*01 | 1094 |
| 998 | gnl\|Fabrus\|VH5-51__IGHD5-18*01__IGHJ4*01 | 1050 | gnl\|Fabrus\|L25__IGKJ3*01 | 1094 |
| 999 | gnl\|Fabrus\|VH5-51__IGHD5-18*01__IGHJ4*01 | 1051 | gnl\|Fabrus\|L25__IGKJ3*01 | 1094 |
| 1000 | gnl\|Fabrus\|VH5-51__IGHD6-25*01__IGHJ4*01 | 1052 | gnl\|Fabrus\|L25__IGKJ3*01 | 1094 |
| 1001 | gnl\|Fabrus\|VH5-51__IGHD7-27*01__IGHJ4*01 | 1053 | gnl\|Fabrus\|L25__IGKJ3*01 | 1094 |
| 1002 | gnl\|Fabrus\|VH6-1__IGHD1-1*01__IGHJ4*01 | 1054 | gnl\|Fabrus\|L25__IGKJ3*01 | 1094 |
| 1003 | gnl\|Fabrus\|VH6-1__IGHD2-15*01__IGHJ4*01 | 1056 | gnl\|Fabrus\|L25__IGKJ3*01 | 1094 |
| 1004 | gnl\|Fabrus\|VH6-1__IGHD3-3*01__IGHJ4*01 | 1059 | gnl\|Fabrus\|L25__IGKJ3*01 | 1094 |
| 1005 | gnl\|Fabrus\|VH6-1__IGHD4-23*01__IGHJ4*01 | 1061 | gnl\|Fabrus\|L25__IGKJ3*01 | 1094 |
| 1006 | gnl\|Fabrus\|VH6-1__IGHD4-11*01__IGHJ6*01 | 1060 | gnl\|Fabrus\|L25__IGKJ3*01 | 1094 |
| 1007 | gnl\|Fabrus\|VH6-1__IGHD5-5*01__IGHJ4*01 | 1062 | gnl\|Fabrus\|L25__IGKJ3*01 | 1094 |
| 1008 | gnl\|Fabrus\|VH6-1__IGHD6-13*01__IGHJ4*01 | 1063 | gnl\|Fabrus\|L25__IGKJ3*01 | 1094 |
| 1009 | gnl\|Fabrus\|VH6-1__IGHD6-25*01__IGHJ6*01 | 1064 | gnl\|Fabrus\|L25__IGKJ3*01 | 1094 |
| 1010 | gnl\|Fabrus\|VH6-1__IGHD7-27*01__IGHJ4*01 | 1065 | gnl\|Fabrus\|L25__IGKJ3*01 | 1094 |
| 1011 | gnl\|Fabrus\|VH4-59__IGHD6-25*01__IGHJ3*01 | 1043 | gnl\|Fabrus\|L25__IGKJ3*01 | 1094 |
| 1012 | gnl\|Fabrus\|VH3-48__IGHD6-6*01__IGHJ1*01 | 923 | gnl\|Fabrus\|L25__IGKJ3*01 | 1094 |
| 1013 | gnl\|Fabrus\|VH3-30__IGHD6-6*01__IGHJ1*01 | 893 | gnl\|Fabrus\|L25__IGKJ3*01 | 1094 |
| 1014 | gnl\|Fabrus\|VH3-66__IGHD6-6*01__IGHJ1*01 | 949 | gnl\|Fabrus\|L25__IGKJ3*01 | 1094 |
| 1015 | gnl\|Fabrus\|VH3-53__IGHD5-5*01__IGHJ4*01 | 938 | gnl\|Fabrus\|L25__IGKJ3*01 | 1094 |
| 1016 | gnl\|Fabrus\|VH2-5__IGHD5-12*01__IGHJ4*01 | 804 | gnl\|Fabrus\|L25__IGKJ3*01 | 1094 |
| 1017 | gnl\|Fabrus\|VH2-70__IGHD5-12*01__IGHJ4*01 | 811 | gnl\|Fabrus\|L25__IGKJ3*01 | 1094 |
| 1018 | gnl\|Fabrus\|VH3-15__IGHD5-12*01__IGHJ4*01 | 835 | gnl\|Fabrus\|L25__IGKJ3*01 | 1094 |
| 1019 | gnl\|Fabrus\|VH3-15__IGHD3-10*01__IGHJ4*01 | 833 | gnl\|Fabrus\|L25__IGKJ3*01 | 1094 |
| 1020 | gnl\|Fabrus\|VH3-49__IGHD5-18*01__IGHJ4*01 | 930 | gnl\|Fabrus\|L25__IGKJ3*01 | 1094 |
| 1021 | gnl\|Fabrus\|VH3-49__IGHD6-13*01__IGHJ4*01 | 931 | gnl\|Fabrus\|L25__IGKJ3*01 | 1094 |
| 1022 | gnl\|Fabrus\|VH3-72__IGHD5-18*01__IGHJ4*01 | 967 | gnl\|Fabrus\|L25__IGKJ3*01 | 1094 |
| 1023 | gnl\|Fabrus\|VH3-72__IGHD6-6*01__IGHJ1*01 | 969 | gnl\|Fabrus\|L25__IGKJ3*01 | 1094 |
| 1024 | gnl\|Fabrus\|VH3-73__IGHD5-12*01__IGHJ4*01 | 977 | gnl\|Fabrus\|L25__IGKJ3*01 | 1094 |
| 1025 | gnl\|Fabrus\|VH3-73__IGHD4-23*01__IGHJ5*01 | 976 | gnl\|Fabrus\|L25__IGKJ3*01 | 1094 |
| 1026 | gnl\|Fabrus\|VH3-43__IGHD3-22*01__IGHJ4*01 | 918 | gnl\|Fabrus\|L25__IGKJ3*01 | 1094 |
| 1027 | gnl\|Fabrus\|VH3-43__IGHD6-13*01__IGHJ4*01 | 921 | gnl\|Fabrus\|L25__IGKJ3*01 | 1094 |
| 1028 | gnl\|Fabrus\|VH3-9__IGHD3-22*01__IGHJ4*01 | 992 | gnl\|Fabrus\|L25__IGKJ3*01 | 1094 |
| 1029 | gnl\|Fabrus\|VH3-9__IGHD1-7*01__IGHJ5*01 | 989 | gnl\|Fabrus\|L25__IGKJ3*01 | 1094 |
| 1030 | gnl\|Fabrus\|VH3-9__IGHD6-13*01__IGHJ4*01 | 995 | gnl\|Fabrus\|L25__IGKJ3*01 | 1094 |
| 1031 | gnl\|Fabrus\|VH4-39__IGHD3-10*01__IGHJ4*01 | 1030 | gnl\|Fabrus\|L25__IGKJ3*01 | 1094 |
| 1032 | gnl\|Fabrus\|VH4-39__IGHD5-12*01__IGHJ4*01 | 1034 | gnl\|Fabrus\|L25__IGKJ3*01 | 1094 |
| 1033 | gnl\|Fabrus\|VH1-18__IGHD6-6*01__IGHJ1*01 | 728 | gnl\|Fabrus\|L25__IGKJ3*01 | 1094 |
| 1034 | gnl\|Fabrus\|VH1-24__IGHD5-12*01__IGHJ4*01 | 735 | gnl\|Fabrus\|L25__IGKJ3*01 | 1094 |
| 1035 | gnl\|Fabrus\|VH1-2__IGHD1-1*01__IGHJ3*01 | 729 | gnl\|Fabrus\|L25__IGKJ3*01 | 1094 |
| 1036 | gnl\|Fabrus\|VH1-3__IGHD6-6*01__IGHJ1*01 | 743 | gnl\|Fabrus\|L25__IGKJ3*01 | 1094 |
| 1037 | gnl\|Fabrus\|VH1-45__IGHD3-10*01__IGHJ4*01 | 748 | gnl\|Fabrus\|L25__IGKJ3*01 | 1094 |
| 1038 | gnl\|Fabrus\|VH1-46__IGHD1-26*01__IGHJ4*01 | 754 | gnl\|Fabrus\|L25__IGKJ3*01 | 1094 |
| 1039 | gnl\|Fabrus\|VH7-81__IGHD2-21*01__IGHJ6*01 | 1068 | gnl\|Fabrus\|L25__IGKJ3*01 | 1094 |
| 1040 | gnl\|Fabrus\|VH2-70__IGHD3-9*01__IGHJ6*01 | 810 | gnl\|Fabrus\|L25__IGKJ3*01 | 1094 |
| 1041 | gnl\|Fabrus\|VH1-58__IGHD3-10*01__IGHJ6*01 | 764 | gnl\|Fabrus\|L25__IGKJ3*01 | 1094 |
| 1042 | gnl\|Fabrus\|VH7-81__IGHD2-21*01__IGHJ2*01 | 1067 | gnl\|Fabrus\|L25__IGKJ3*01 | 1094 |
| 1043 | gnl\|Fabrus\|VH4-28__IGHD3-9*01__IGHJ6*01 | 1002 | gnl\|Fabrus\|L25__IGKJ3*01 | 1094 |
| 1044 | gnl\|Fabrus\|VH4-31__IGHD2-15*01__IGHJ2*01 | 1008 | gnl\|Fabrus\|L25__IGKJ3*01 | 1094 |
| 1045 | gnl\|Fabrus\|VH2-5__IGHD3-9*01__IGHJ6*01 | 803 | gnl\|Fabrus\|L25__IGKJ3*01 | 1094 |
| 1046 | gnl\|Fabrus\|VH1-8__IGHD2-15*01__IGHJ6*01 | 783 | gnl\|Fabrus\|L25__IGKJ3*01 | 1094 |
| 1047 | gnl\|Fabrus\|VH2-70__IGHD2-15*01__IGHJ2*01 | 808 | gnl\|Fabrus\|L25__IGKJ3*01 | 1094 |
| 1048 | gnl\|Fabrus\|VH3-38__IGHD3-10*01__IGHJ6*01 | 907 | gnl\|Fabrus\|L25__IGKJ3*01 | 1094 |
| 1049 | gnl\|Fabrus\|VH3-16__IGHD1-7*01__IGHJ6*01 | 838 | gnl\|Fabrus\|L25__IGKJ3*01 | 1094 |
| 1050 | gnl\|Fabrus\|VH3-73__IGHD3-9*01__IGHJ6*01 | 974 | gnl\|Fabrus\|L25__IGKJ3*01 | 1094 |
| 1051 | gnl\|Fabrus\|VH3-11__IGHD3-9*01__IGHJ6*01 | 816 | gnl\|Fabrus\|L25__IGKJ3*01 | 1094 |
| 1052 | gnl\|Fabrus\|VH3-11__IGHD6-6*01__IGHJ1*01 | 820 | gnl\|Fabrus\|L25__IGKJ3*01 | 1094 |
| 1053 | gnl\|Fabrus\|VH3-20__IGHD5-12*01__IGHJ4*01 | 852 | gnl\|Fabrus\|L25__IGKJ3*01 | 1094 |

TABLE 4-continued

Exemplary Paired Nucleic Acid Library

| HEAVY CHAIN | SEQ ID NO | LIGHT CHAIN | SEQ ID NO |
|---|---|---|---|
| 1054 gnl|Fabrus|VH3-16__IGHD2-15*01__IGHJ2*01 | 839 | gnl|Fabrus|L25__IGKJ3*01 | 1094 |
| 1055 gnl|Fabrus|VH3-7__IGHD6-6*01__IGHJ1*01 | 960 | gnl|Fabrus|L25__IGKJ3*01 | 1094 |
| 1056 gnl|Fabrus|VH3-16__IGHD6-13*01__IGHJ4*01 | 844 | gnl|Fabrus|L25__IGKJ3*01 | 1094 |
| 1057 gnl|Fabrus|VH3-23__IGHD1-1*01__IGHJ4*01 | 863 | gnl|Fabrus|A27__IGKJ1*01 | 1080 |
| 1058 gnl|Fabrus|VH3-23__IGHD2-15*01__IGHJ4*01 | 866 | gnl|Fabrus|A27__IGKJ1*01 | 1080 |
| 1059 gnl|Fabrus|VH3-23__IGHD3-22*01__IGHJ4*01 | 870 | gnl|Fabrus|A27__IGKJ1*01 | 1080 |
| 1060 gnl|Fabrus|VH3-23__IGHD4-11*01__IGHJ4*01 | 872 | gnl|Fabrus|A27__IGKJ1*01 | 1080 |
| 1061 gnl|Fabrus|VH3-23__IGHD5-12*01__IGHJ4*01 | 874 | gnl|Fabrus|A27__IGKJ1*01 | 1080 |
| 1062 gnl|Fabrus|VH3-23__IGHD5-5*01__IGHJ4*01 | 876 | gnl|Fabrus|A27__IGKJ1*01 | 1080 |
| 1063 gnl|Fabrus|VH3-23__IGHD6-13*01__IGHJ4*01 | 877 | gnl|Fabrus|A27__IGKJ1*01 | 1080 |
| 1064 gnl|Fabrus|VH3-23__IGHD7-27*01__IGHJ4*01 | 880 | gnl|Fabrus|A27__IGKJ1*01 | 1080 |
| 1065 gnl|Fabrus|VH3-23__IGHD7-27*01__IGHJ6*01 | 881 | gnl|Fabrus|A27__IGKJ1*01 | 1080 |
| 1066 gnl|Fabrus|VH1-69__IGHD1-14*01__IGHJ4*01 | 770 | gnl|Fabrus|A27__IGKJ1*01 | 1080 |
| 1067 gnl|Fabrus|VH1-69__IGHD2-2*01__IGHJ4*01 | 771 | gnl|Fabrus|A27__IGKJ1*01 | 1080 |
| 1068 gnl|Fabrus|VH1-69__IGHD2-8*01__IGHJ6*01 | 772 | gnl|Fabrus|A27__IGKJ1*01 | 1080 |
| 1069 gnl|Fabrus|VH1-69__IGHD3-16*01__IGHJ4*01 | 773 | gnl|Fabrus|A27__IGKJ1*01 | 1080 |
| 1070 gnl|Fabrus|VH1-69__IGHD3-3*01__IGHJ4*01 | 774 | gnl|Fabrus|A27__IGKJ1*01 | 1080 |
| 1071 gnl|Fabrus|VH1-69__IGHD4-17*01__IGHJ4*01 | 776 | gnl|Fabrus|A27__IGKJ1*01 | 1080 |
| 1072 gnl|Fabrus|VH1-69__IGHD5-12*01__IGHJ4*01 | 777 | gnl|Fabrus|A27__IGKJ1*01 | 1080 |
| 1073 gnl|Fabrus|VH1-69__IGHD6-19*01__IGHJ4*01 | 779 | gnl|Fabrus|A27__IGKJ1*01 | 1080 |
| 1074 gnl|Fabrus|VH1-69__IGHD7-27*01__IGHJ4*01 | 781 | gnl|Fabrus|A27__IGKJ1*01 | 1080 |
| 1075 gnl|Fabrus|VH4-34__IGHD1-7*01__IGHJ4*01 | 1017 | gnl|Fabrus|A27__IGKJ1*01 | 1080 |
| 1076 gnl|Fabrus|VH4-34__IGHD2-2*01__IGHJ4*01 | 1018 | gnl|Fabrus|A27__IGKJ1*01 | 1080 |
| 1077 gnl|Fabrus|VH4-34__IGHD3-16*01__IGHJ4*01 | 1019 | gnl|Fabrus|A27__IGKJ1*01 | 1080 |
| 1078 gnl|Fabrus|VH4-34__IGHD4-17*01__IGHJ4*01 | 1021 | gnl|Fabrus|A27__IGKJ1*01 | 1080 |
| 1079 gnl|Fabrus|VH4-34__IGHD5-12*01__IGHJ4*01 | 1022 | gnl|Fabrus|A27__IGKJ1*01 | 1080 |
| 1080 gnl|Fabrus|VH4-34__IGHD6-13*01__IGHJ4*01 | 1023 | gnl|Fabrus|A27__IGKJ1*01 | 1080 |
| 1081 gnl|Fabrus|VH4-34__IGHD6-25*01__IGHJ6*01 | 1024 | gnl|Fabrus|A27__IGKJ1*01 | 1080 |
| 1082 gnl|Fabrus|VH4-34__IGHD7-27*01__IGHJ4*01 | 1026 | gnl|Fabrus|A27__IGKJ1*01 | 1080 |
| 1083 gnl|Fabrus|VH2-26__IGHD1-20*01__IGHJ4*01 | 789 | gnl|Fabrus|A27__IGKJ1*01 | 1080 |
| 1084 gnl|Fabrus|VH2-26__IGHD2-2*01__IGHJ4*01 | 791 | gnl|Fabrus|A27__IGKJ1*01 | 1080 |
| 1085 gnl|Fabrus|VH2-26__IGHD3-10*01__IGHJ4*01 | 792 | gnl|Fabrus|A27__IGKJ1*01 | 1080 |
| 1086 gnl|Fabrus|VH2-26__IGHD4-11*01__IGHJ4*01 | 794 | gnl|Fabrus|A27__IGKJ1*01 | 1080 |
| 1087 gnl|Fabrus|VH2-26__IGHD5-18*01__IGHJ4*01 | 796 | gnl|Fabrus|A27__IGKJ1*01 | 1080 |
| 1088 gnl|Fabrus|VH2-26__IGHD6-13*01__IGHJ4*01 | 797 | gnl|Fabrus|A27__IGKJ1*01 | 1080 |
| 1089 gnl|Fabrus|VH2-26__IGHD7-27*01__IGHJ4*01 | 798 | gnl|Fabrus|A27__IGKJ1*01 | 1080 |
| 1090 gnl|Fabrus|VH5-51__IGHD1-14*01__IGHJ4*01 | 1044 | gnl|Fabrus|A27__IGKJ1*01 | 1080 |
| 1091 gnl|Fabrus|VH5-51__IGHD2-8*01__IGHJ4*01 | 1046 | gnl|Fabrus|A27__IGKJ1*01 | 1080 |
| 1092 gnl|Fabrus|VH5-51__IGHD3-3*01__IGHJ4*01 | 1048 | gnl|Fabrus|A27__IGKJ1*01 | 1080 |
| 1093 gnl|Fabrus|VH5-51__IGHD4-17*01__IGHJ4*01 | 1049 | gnl|Fabrus|A27__IGKJ1*01 | 1080 |
| 1094 gnl|Fabrus|VH5-51__IGHD5-18*01__IGHJ4*01 | 1050 | gnl|Fabrus|A27__IGKJ1*01 | 1080 |
| 1095 gnl|Fabrus|VH5-51__IGHD5-18*01__IGHJ4*01 | 1051 | gnl|Fabrus|A27__IGKJ1*01 | 1080 |
| 1096 gnl|Fabrus|VH5-51__IGHD6-25*01__IGHJ4*01 | 1052 | gnl|Fabrus|A27__IGKJ1*01 | 1080 |
| 1097 gnl|Fabrus|VH5-51__IGHD7-27*01__IGHJ4*01 | 1053 | gnl|Fabrus|A27__IGKJ1*01 | 1080 |
| 1098 gnl|Fabrus|VH6-1__IGHD1-1*01__IGHJ4*01 | 1054 | gnl|Fabrus|A27__IGKJ1*01 | 1080 |
| 1099 gnl|Fabrus|VH6-1__IGHD2-15*01__IGHJ4*01 | 1056 | gnl|Fabrus|A27__IGKJ1*01 | 1080 |
| 1100 gnl|Fabrus|VH6-1__IGHD3-3*01__IGHJ4*01 | 1059 | gnl|Fabrus|A27__IGKJ1*01 | 1080 |
| 1101 gnl|Fabrus|VH6-1__IGHD4-23*01__IGHJ4*01 | 1061 | gnl|Fabrus|A27__IGKJ1*01 | 1080 |
| 1102 gnl|Fabrus|VH6-1__IGHD4-11*01__IGHJ6*01 | 1060 | gnl|Fabrus|A27__IGKJ1*01 | 1080 |
| 1103 gnl|Fabrus|VH6-1__IGHD5-5*01__IGHJ4*01 | 1062 | gnl|Fabrus|A27__IGKJ1*01 | 1080 |
| 1104 gnl|Fabrus|VH6-1__IGHD6-13*01__IGHJ4*01 | 1063 | gnl|Fabrus|A27__IGKJ1*01 | 1080 |
| 1105 gnl|Fabrus|VH6-1__IGHD6-25*01__IGHJ6*01 | 1064 | gnl|Fabrus|A27__IGKJ1*01 | 1080 |
| 1106 gnl|Fabrus|VH6-1__IGHD7-27*01__IGHJ4*01 | 1065 | gnl|Fabrus|A27__IGKJ1*01 | 1080 |
| 1107 gnl|Fabrus|VH4-59__IGHD6-25*01__IGHJ3*01 | 1043 | gnl|Fabrus|A27__IGKJ1*01 | 1080 |
| 1108 gnl|Fabrus|VH3-48__IGHD6-6*01__IGHJ1*01 | 923 | gnl|Fabrus|A27__IGKJ1*01 | 1080 |
| 1109 gnl|Fabrus|VH3-30__IGHD6-6*01__IGHJ1*01 | 893 | gnl|Fabrus|A27__IGKJ1*01 | 1080 |
| 1110 gnl|Fabrus|VH3-66__IGHD6-6*01__IGHJ1*01 | 949 | gnl|Fabrus|A27__IGKJ1*01 | 1080 |
| 1111 gnl|Fabrus|VH3-53__IGHD5-5*01__IGHJ4*01 | 938 | gnl|Fabrus|A27__IGKJ1*01 | 1080 |
| 1112 gnl|Fabrus|VH2-5__IGHD5-12*01__IGHJ4*01 | 804 | gnl|Fabrus|A27__IGKJ1*01 | 1080 |
| 1113 gnl|Fabrus|VH2-70__IGHD5-12*01__IGHJ4*01 | 811 | gnl|Fabrus|A27__IGKJ1*01 | 1080 |
| 1114 gnl|Fabrus|VH3-15__IGHD5-12*01__IGHJ4*01 | 835 | gnl|Fabrus|A27__IGKJ1*01 | 1080 |
| 1115 gnl|Fabrus|VH3-15__IGHD3-10*01__IGHJ4*01 | 833 | gnl|Fabrus|A27__IGKJ1*01 | 1080 |
| 1116 gnl|Fabrus|VH3-49__IGHD5-18*01__IGHJ4*01 | 930 | gnl|Fabrus|A27__IGKJ1*01 | 1080 |
| 1117 gnl|Fabrus|VH3-49__IGHD6-13*01__IGHJ4*01 | 931 | gnl|Fabrus|A27__IGKJ1*01 | 1080 |
| 1118 gnl|Fabrus|VH3-72__IGHD5-18*01__IGHJ4*01 | 967 | gnl|Fabrus|A27__IGKJ1*01 | 1080 |
| 1119 gnl|Fabrus|VH3-72__IGHD6-6*01__IGHJ1*01 | 969 | gnl|Fabrus|A27__IGKJ1*01 | 1080 |
| 1120 gnl|Fabrus|VH3-73__IGHD5-12*01__IGHJ4*01 | 977 | gnl|Fabrus|A27__IGKJ1*01 | 1080 |
| 1121 gnl|Fabrus|VH3-73__IGHD4-23*01__IGHJ5*01 | 976 | gnl|Fabrus|A27__IGKJ1*01 | 1080 |
| 1122 gnl|Fabrus|VH3-43__IGHD3-22*01__IGHJ4*01 | 918 | gnl|Fabrus|A27__IGKJ1*01 | 1080 |
| 1123 gnl|Fabrus|VH3-43__IGHD6-13*01__IGHJ4*01 | 921 | gnl|Fabrus|A27__IGKJ1*01 | 1080 |
| 1124 gnl|Fabrus|VH3-9__IGHD3-22*01__IGHJ4*01 | 992 | gnl|Fabrus|A27__IGKJ1*01 | 1080 |
| 1125 gnl|Fabrus|VH3-9__IGHD1-7*01__IGHJ5*01 | 989 | gnl|Fabrus|A27__IGKJ1*01 | 1080 |
| 1126 gnl|Fabrus|VH3-9__IGHD6-13*01__IGHJ4*01 | 995 | gnl|Fabrus|A27__IGKJ1*01 | 1080 |
| 1127 gnl|Fabrus|VH4-39__IGHD3-10*01__IGHJ4*01 | 1030 | gnl|Fabrus|A27__IGKJ1*01 | 1080 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1128 | gnl\|Fabrus\|VH4-39__IGHD5-12*01__IGHJ4*01 | 1034 | gnl\|Fabrus\|A27__IGKJ1*01 | 1080 |
| 1129 | gnl\|Fabrus\|VH1-18__IGHD6-6*01__IGHJ1*01 | 728 | gnl\|Fabrus\|A27__IGKJ1*01 | 1080 |
| 1130 | gnl\|Fabrus\|VH1-24__IGHD5-12*01__IGHJ4*01 | 735 | gnl\|Fabrus\|A27__IGKJ1*01 | 1080 |
| 1131 | gnl\|Fabrus\|VH1-2__IGHD1-1*01__IGHJ3*01 | 729 | gnl\|Fabrus\|A27__IGKJ1*01 | 1080 |
| 1132 | gnl\|Fabrus\|VH1-3__IGHD6-6*01__IGHJ1*01 | 743 | gnl\|Fabrus\|A27__IGKJ1*01 | 1080 |
| 1133 | gnl\|Fabrus\|VH1-45__IGHD3-10*01__IGHJ4*01 | 748 | gnl\|Fabrus\|A27__IGKJ1*01 | 1080 |
| 1134 | gnl\|Fabrus\|VH1-46__IGHD1-26*01__IGHJ4*01 | 754 | gnl\|Fabrus\|A27__IGKJ1*01 | 1080 |
| 1135 | gnl\|Fabrus\|VH7-81__IGHD2-21*01__IGHJ6*01 | 1068 | gnl\|Fabrus\|A27__IGKJ1*01 | 1080 |
| 1136 | gnl\|Fabrus\|VH2-70__IGHD3-9*01__IGHJ6*01 | 810 | gnl\|Fabrus\|A27__IGKJ1*01 | 1080 |
| 1137 | gnl\|Fabrus\|VH1-58__IGHD3-10*01__IGHJ6*01 | 764 | gnl\|Fabrus\|A27__IGKJ1*01 | 1080 |
| 1138 | gnl\|Fabrus\|VH7-81__IGHD2-21*01__IGHJ2*01 | 1067 | gnl\|Fabrus\|A27__IGKJ1*01 | 1080 |
| 1139 | gnl\|Fabrus\|VH4-28__IGHD3-9*01__IGHJ6*01 | 1002 | gnl\|Fabrus\|A27__IGKJ1*01 | 1080 |
| 1140 | gnl\|Fabrus\|VH4-31__IGHD2-15*01__IGHJ2*01 | 1008 | gnl\|Fabrus\|A27__IGKJ1*01 | 1080 |
| 1141 | gnl\|Fabrus\|VH2-5__IGHD3-9*01__IGHJ6*01 | 803 | gnl\|Fabrus\|A27__IGKJ1*01 | 1080 |
| 1142 | gnl\|Fabrus\|VH1-8__IGHD2-15*01__IGHJ6*01 | 783 | gnl\|Fabrus\|A27__IGKJ1*01 | 1080 |
| 1143 | gnl\|Fabrus\|VH2-70__IGHD2-15*01__IGHJ2*01 | 808 | gnl\|Fabrus\|A27__IGKJ1*01 | 1080 |
| 1144 | gnl\|Fabrus\|VH3-38__IGHD3-10*01__IGHJ4*01 | 907 | gnl\|Fabrus\|A27__IGKJ1*01 | 1080 |
| 1145 | gnl\|Fabrus\|VH3-16__IGHD1-7*01__IGHJ6*01 | 838 | gnl\|Fabrus\|A27__IGKJ1*01 | 1080 |
| 1146 | gnl\|Fabrus\|VH3-73__IGHD3-9*01__IGHJ6*01 | 974 | gnl\|Fabrus\|A27__IGKJ1*01 | 1080 |
| 1147 | gnl\|Fabrus\|VH3-11__IGHD3-9*01__IGHJ6*01 | 816 | gnl\|Fabrus\|A27__IGKJ1*01 | 1080 |
| 1148 | gnl\|Fabrus\|VH3-11__IGHD6-6*01__IGHJ1*01 | 820 | gnl\|Fabrus\|A27__IGKJ1*01 | 1080 |
| 1149 | gnl\|Fabrus\|VH3-20__IGHD5-12*01__IGHJ4*01 | 852 | gnl\|Fabrus\|A27__IGKJ1*01 | 1080 |
| 1150 | gnl\|Fabrus\|VH3-16__IGHD2-15*01__IGHJ2*01 | 839 | gnl\|Fabrus\|A27__IGKJ1*01 | 1080 |
| 1151 | gnl\|Fabrus\|VH3-7__IGHD6-6*01__IGHJ1*01 | 960 | gnl\|Fabrus\|A27__IGKJ1*01 | 1080 |
| 1152 | gnl\|Fabrus\|VH3-16__IGHD6-13*01__IGHJ4*01 | 844 | gnl\|Fabrus\|A27__IGKJ1*01 | 1080 |
| 1153 | gnl\|Fabrus\|VH3-23__IGHD1-1*01__IGHJ4*01 | 863 | gnl\|Fabrus\|A2__IGKJ1*01 | 1076 |
| 1154 | gnl\|Fabrus\|VH3-23__IGHD2-15*01__IGHJ4*01 | 866 | gnl\|Fabrus\|A2__IGKJ1*01 | 1076 |
| 1155 | gnl\|Fabrus\|VH3-23__IGHD3-22*01__IGHJ4*01 | 870 | gnl\|Fabrus\|A2__IGKJ1*01 | 1076 |
| 1156 | gnl\|Fabrus\|VH3-23__IGHD4-11*01__IGHJ4*01 | 872 | gnl\|Fabrus\|A2__IGKJ1*01 | 1076 |
| 1157 | gnl\|Fabrus\|VH3-23__IGHD5-12*01__IGHJ4*01 | 874 | gnl\|Fabrus\|A2__IGKJ1*01 | 1076 |
| 1158 | gnl\|Fabrus\|VH3-23__IGHD5-5*01__IGHJ4*01 | 876 | gnl\|Fabrus\|A2__IGKJ1*01 | 1076 |
| 1159 | gnl\|Fabrus\|VH3-23__IGHD6-13*01__IGHJ4*01 | 877 | gnl\|Fabrus\|A2__IGKJ1*01 | 1076 |
| 1160 | gnl\|Fabrus\|VH3-23__IGHD7-27*01__IGHJ4*01 | 880 | gnl\|Fabrus\|A2__IGKJ1*01 | 1076 |
| 1161 | gnl\|Fabrus\|VH3-23__IGHD7-27*01__IGHJ6*01 | 881 | gnl\|Fabrus\|A2__IGKJ1*01 | 1076 |
| 1162 | gnl\|Fabrus\|VH1-69__IGHD1-14*01__IGHJ4*01 | 770 | gnl\|Fabrus\|A2__IGKJ1*01 | 1076 |
| 1163 | gnl\|Fabrus\|VH1-69__IGHD2-2*01__IGHJ4*01 | 771 | gnl\|Fabrus\|A2__IGKJ1*01 | 1076 |
| 1164 | gnl\|Fabrus\|VH1-69__IGHD2-8*01__IGHJ6*01 | 772 | gnl\|Fabrus\|A2__IGKJ1*01 | 1076 |
| 1165 | gnl\|Fabrus\|VH1-69__IGHD3-16*01__IGHJ4*01 | 773 | gnl\|Fabrus\|A2__IGKJ1*01 | 1076 |
| 1166 | gnl\|Fabrus\|VH1-69__IGHD3-3*01__IGHJ4*01 | 774 | gnl\|Fabrus\|A2__IGKJ1*01 | 1076 |
| 1167 | gnl\|Fabrus\|VH1-69__IGHD4-17*01__IGHJ4*01 | 776 | gnl\|Fabrus\|A2__IGKJ1*01 | 1076 |
| 1168 | gnl\|Fabrus\|VH1-69__IGHD5-12*01__IGHJ4*01 | 777 | gnl\|Fabrus\|A2__IGKJ1*01 | 1076 |
| 1169 | gnl\|Fabrus\|VH1-69__IGHD6-19*01__IGHJ4*01 | 779 | gnl\|Fabrus\|A2__IGKJ1*01 | 1076 |
| 1170 | gnl\|Fabrus\|VH1-69__IGHD7-27*01__IGHJ4*01 | 781 | gnl\|Fabrus\|A2__IGKJ1*01 | 1076 |
| 1171 | gnl\|Fabrus\|VH4-34__IGHD1-7*01__IGHJ4*01 | 1017 | gnl\|Fabrus\|A2__IGKJ1*01 | 1076 |
| 1172 | gnl\|Fabrus\|VH4-34__IGHD2-2*01__IGHJ4*01 | 1018 | gnl\|Fabrus\|A2__IGKJ1*01 | 1076 |
| 1173 | gnl\|Fabrus\|VH4-34__IGHD3-16*01__IGHJ4*01 | 1019 | gnl\|Fabrus\|A2__IGKJ1*01 | 1076 |
| 1174 | gnl\|Fabrus\|VH4-34__IGHD4-17*01__IGHJ4*01 | 1021 | gnl\|Fabrus\|A2__IGKJ1*01 | 1076 |
| 1175 | gnl\|Fabrus\|VH4-34__IGHD5-12*01__IGHJ4*01 | 1022 | gnl\|Fabrus\|A2__IGKJ1*01 | 1076 |
| 1176 | gnl\|Fabrus\|VH4-34__IGHD6-13*01__IGHJ4*01 | 1023 | gnl\|Fabrus\|A2__IGKJ1*01 | 1076 |
| 1177 | gnl\|Fabrus\|VH4-34__IGHD6-25*01__IGHJ6*01 | 1024 | gnl\|Fabrus\|A2__IGKJ1*01 | 1076 |
| 1178 | gnl\|Fabrus\|VH4-34__IGHD7-27*01__IGHJ4*01 | 1026 | gnl\|Fabrus\|A2__IGKJ1*01 | 1076 |
| 1179 | gnl\|Fabrus\|VH2-26__IGHD1-20*01__IGHJ4*01 | 789 | gnl\|Fabrus\|A2__IGKJ1*01 | 1076 |
| 1180 | gnl\|Fabrus\|VH2-26__IGHD2-2*01__IGHJ4*01 | 791 | gnl\|Fabrus\|A2__IGKJ1*01 | 1076 |
| 1181 | gnl\|Fabrus\|VH2-26__IGHD3-10*01__IGHJ4*01 | 792 | gnl\|Fabrus\|A2__IGKJ1*01 | 1076 |
| 1182 | gnl\|Fabrus\|VH2-26__IGHD4-11*01__IGHJ4*01 | 794 | gnl\|Fabrus\|A2__IGKJ1*01 | 1076 |
| 1183 | gnl\|Fabrus\|VH2-26__IGHD5-18*01__IGHJ4*01 | 796 | gnl\|Fabrus\|A2__IGKJ1*01 | 1076 |
| 1184 | gnl\|Fabrus\|VH2-26__IGHD6-13*01__IGHJ4*01 | 797 | gnl\|Fabrus\|A2__IGKJ1*01 | 1076 |
| 1185 | gnl\|Fabrus\|VH2-26__IGHD7-27*01__IGHJ4*01 | 798 | gnl\|Fabrus\|A2__IGKJ1*01 | 1076 |
| 1186 | gnl\|Fabrus\|VH5-51__IGHD1-14*01__IGHJ4*01 | 1044 | gnl\|Fabrus\|A2__IGKJ1*01 | 1076 |
| 1187 | gnl\|Fabrus\|VH5-51__IGHD2-8*01__IGHJ4*01 | 1046 | gnl\|Fabrus\|A2__IGKJ1*01 | 1076 |
| 1188 | gnl\|Fabrus\|VH5-51__IGHD3-3*01__IGHJ4*01 | 1048 | gnl\|Fabrus\|A2__IGKJ1*01 | 1076 |
| 1189 | gnl\|Fabrus\|VH5-51__IGHD4-17*01__IGHJ4*01 | 1049 | gnl\|Fabrus\|A2__IGKJ1*01 | 1076 |
| 1190 | gnl\|Fabrus\|VH5-51__IGHD5-18*01__IGHJ4*01 | 1050 | gnl\|Fabrus\|A2__IGKJ1*01 | 1076 |
| 1191 | gnl\|Fabrus\|VH5-51__IGHD5-18*01__IGHJ4*01 | 1051 | gnl\|Fabrus\|A2__IGKJ1*01 | 1076 |
| 1192 | gnl\|Fabrus\|VH5-51__IGHD6-25*01__IGHJ4*01 | 1052 | gnl\|Fabrus\|A2__IGKJ1*01 | 1076 |
| 1193 | gnl\|Fabrus\|VH5-51__IGHD7-27*01__IGHJ4*01 | 1053 | gnl\|Fabrus\|A2__IGKJ1*01 | 1076 |
| 1194 | gnl\|Fabrus\|VH6-1__IGHD1-1*01__IGHJ4*01 | 1054 | gnl\|Fabrus\|A2__IGKJ1*01 | 1076 |
| 1195 | gnl\|Fabrus\|VH6-1__IGHD2-15*01__IGHJ4*01 | 1056 | gnl\|Fabrus\|A2__IGKJ1*01 | 1076 |
| 1196 | gnl\|Fabrus\|VH6-1__IGHD3-3*01__IGHJ4*01 | 1059 | gnl\|Fabrus\|A2__IGKJ1*01 | 1076 |
| 1197 | gnl\|Fabrus\|VH6-1__IGHD4-23*01__IGHJ4*01 | 1061 | gnl\|Fabrus\|A2__IGKJ1*01 | 1076 |
| 1198 | gnl\|Fabrus\|VH6-1__IGHD4-11*01__IGHJ6*01 | 1060 | gnl\|Fabrus\|A2__IGKJ1*01 | 1076 |
| 1199 | gnl\|Fabrus\|VH6-1__IGHD5-5*01__IGHJ4*01 | 1062 | gnl\|Fabrus\|A2__IGKJ1*01 | 1076 |
| 1200 | gnl\|Fabrus\|VH6-1__IGHD6-13*01__IGHJ4*01 | 1063 | gnl\|Fabrus\|A2__IGKJ1*01 | 1076 |
| 1201 | gnl\|Fabrus\|VH6-1__IGHD6-25*01__IGHJ6*01 | 1064 | gnl\|Fabrus\|A2__IGKJ1*01 | 1076 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1202 | gnl|Fabrus|VH6-1__IGHD7-27*01__IGHJ4*01 | 1065 | gnl|Fabrus|A2__IGKJ1*01 | 1076 |
| 1203 | gnl|Fabrus|VH4-59__IGHD6-25*01__IGHJ3*01 | 1043 | gnl|Fabrus|A2__IGKJ1*01 | 1076 |
| 1204 | gnl|Fabrus|VH3-48__IGHD6-6*01__IGHJ1*01 | 923 | gnl|Fabrus|A2__IGKJ1*01 | 1076 |
| 1205 | gnl|Fabrus|VH3-30__IGHD6-6*01__IGHJ1*01 | 893 | gnl|Fabrus|A2__IGKJ1*01 | 1076 |
| 1206 | gnl|Fabrus|VH3-66__IGHD6-6*01__IGHJ1*01 | 949 | gnl|Fabrus|A2__IGKJ1*01 | 1076 |
| 1207 | gnl|Fabrus|VH3-53__IGHD5-5*01__IGHJ4*01 | 938 | gnl|Fabrus|A2__IGKJ1*01 | 1076 |
| 1208 | gnl|Fabrus|VH2-5__IGHD5-12*01__IGHJ4*01 | 804 | gnl|Fabrus|A2__IGKJ1*01 | 1076 |
| 1209 | gnl|Fabrus|VH2-70__IGHD5-12*01__IGHJ4*01 | 811 | gnl|Fabrus|A2__IGKJ1*01 | 1076 |
| 1210 | gnl|Fabrus|VH3-15__IGHD5-12*01__IGHJ4*01 | 835 | gnl|Fabrus|A2__IGKJ1*01 | 1076 |
| 1211 | gnl|Fabrus|VH3-15__IGHD3-10*01__IGHJ4*01 | 833 | gnl|Fabrus|A2__IGKJ1*01 | 1076 |
| 1212 | gnl|Fabrus|VH3-49__IGHD5-18*01__IGHJ4*01 | 930 | gnl|Fabrus|A2__IGKJ1*01 | 1076 |
| 1213 | gnl|Fabrus|VH3-49__IGHD6-13*01__IGHJ4*01 | 931 | gnl|Fabrus|A2__IGKJ1*01 | 1076 |
| 1214 | gnl|Fabrus|VH3-72__IGHD5-18*01__IGHJ4*01 | 967 | gnl|Fabrus|A2__IGKJ1*01 | 1076 |
| 1215 | gnl|Fabrus|VH3-72__IGHD6-6*01__IGHJ1*01 | 969 | gnl|Fabrus|A2__IGKJ1*01 | 1076 |
| 1216 | gnl|Fabrus|VH3-73__IGHD5-12*01__IGHJ4*01 | 977 | gnl|Fabrus|A2__IGKJ1*01 | 1076 |
| 1217 | gnl|Fabrus|VH3-73__IGHD4-23*01__IGHJ5*01 | 976 | gnl|Fabrus|A2__IGKJ1*01 | 1076 |
| 1218 | gnl|Fabrus|VH3-43__IGHD3-22*01__IGHJ4*01 | 918 | gnl|Fabrus|A2__IGKJ1*01 | 1076 |
| 1219 | gnl|Fabrus|VH3-43__IGHD6-13*01__IGHJ4*01 | 921 | gnl|Fabrus|A2__IGKJ1*01 | 1076 |
| 1220 | gnl|Fabrus|VH3-9__IGHD3-22*01__IGHJ4*01 | 992 | gnl|Fabrus|A2__IGKJ1*01 | 1076 |
| 1221 | gnl|Fabrus|VH3-9__IGHD1-7*01__IGHJ5*01 | 989 | gnl|Fabrus|A2__IGKJ1*01 | 1076 |
| 1222 | gnl|Fabrus|VH3-9__IGHD6-13*01__IGHJ4*01 | 995 | gnl|Fabrus|A2__IGKJ1*01 | 1076 |
| 1223 | gnl|Fabrus|VH4-39__IGHD3-10*01__IGHJ4*01 | 1030 | gnl|Fabrus|A2__IGKJ1*01 | 1076 |
| 1224 | gnl|Fabrus|VH4-39__IGHD5-12*01__IGHJ4*01 | 1034 | gnl|Fabrus|A2__IGKJ1*01 | 1076 |
| 1225 | gnl|Fabrus|VH1-18__IGHD6-6*01__IGHJ1*01 | 728 | gnl|Fabrus|A2__IGKJ1*01 | 1076 |
| 1226 | gnl|Fabrus|VH1-24__IGHD5-12*01__IGHJ4*01 | 735 | gnl|Fabrus|A2__IGKJ1*01 | 1076 |
| 1227 | gnl|Fabrus|VH1-2__IGHD1-1*01__IGHJ3*01 | 729 | gnl|Fabrus|A2__IGKJ1*01 | 1076 |
| 1228 | gnl|Fabrus|VH1-3__IGHD6-6*01__IGHJ1*01 | 743 | gnl|Fabrus|A2__IGKJ1*01 | 1076 |
| 1229 | gnl|Fabrus|VH1-45__IGHD3-10*01__IGHJ4*01 | 748 | gnl|Fabrus|A2__IGKJ1*01 | 1076 |
| 1230 | gnl|Fabrus|VH1-46__IGHD1-26*01__IGHJ4*01 | 754 | gnl|Fabrus|A2__IGKJ1*01 | 1076 |
| 1231 | gnl|Fabrus|VH7-81__IGHD2-21*01__IGHJ6*01 | 1068 | gnl|Fabrus|A2__IGKJ1*01 | 1076 |
| 1232 | gnl|Fabrus|VH2-70__IGHD3-9*01__IGHJ6*01 | 810 | gnl|Fabrus|A2__IGKJ1*01 | 1076 |
| 1233 | gnl|Fabrus|VH1-58__IGHD3-10*01__IGHJ6*01 | 764 | gnl|Fabrus|A2__IGKJ1*01 | 1076 |
| 1234 | gnl|Fabrus|VH7-81__IGHD2-21*01__IGHJ2*01 | 1067 | gnl|Fabrus|A2__IGKJ1*01 | 1076 |
| 1235 | gnl|Fabrus|VH4-28__IGHD3-9*01__IGHJ6*01 | 1002 | gnl|Fabrus|A2__IGKJ1*01 | 1076 |
| 1236 | gnl|Fabrus|VH4-31__IGHD2-15*01__IGHJ2*01 | 1008 | gnl|Fabrus|A2__IGKJ1*01 | 1076 |
| 1237 | gnl|Fabrus|VH2-5__IGHD3-9*01__IGHJ6*01 | 803 | gnl|Fabrus|A2__IGKJ1*01 | 1076 |
| 1238 | gnl|Fabrus|VH1-8__IGHD2-15*01__IGHJ6*01 | 783 | gnl|Fabrus|A2__IGKJ1*01 | 1076 |
| 1239 | gnl|Fabrus|VH2-70__IGHD2-15*01__IGHJ2*01 | 808 | gnl|Fabrus|A2__IGKJ1*01 | 1076 |
| 1240 | gnl|Fabrus|VH3-38__IGHD3-10*01__IGHJ4*01 | 907 | gnl|Fabrus|A2__IGKJ1*01 | 1076 |
| 1241 | gnl|Fabrus|VH3-16__IGHD1-7*01__IGHJ6*01 | 838 | gnl|Fabrus|A2__IGKJ1*01 | 1076 |
| 1242 | gnl|Fabrus|VH3-73__IGHD3-9*01__IGHJ6*01 | 974 | gnl|Fabrus|A2__IGKJ1*01 | 1076 |
| 1243 | gnl|Fabrus|VH3-11__IGHD3-9*01__IGHJ6*01 | 816 | gnl|Fabrus|A2__IGKJ1*01 | 1076 |
| 1244 | gnl|Fabrus|VH3-11__IGHD6-6*01__IGHJ1*01 | 820 | gnl|Fabrus|A2__IGKJ1*01 | 1076 |
| 1245 | gnl|Fabrus|VH3-20__IGHD5-12*01__IGHJ4*01 | 852 | gnl|Fabrus|A2__IGKJ1*01 | 1076 |
| 1246 | gnl|Fabrus|VH3-16__IGHD2-15*01__IGHJ2*01 | 839 | gnl|Fabrus|A2__IGKJ1*01 | 1076 |
| 1247 | gnl|Fabrus|VH3-7__IGHD6-6*01__IGHJ1*01 | 960 | gnl|Fabrus|A2__IGKJ1*01 | 1076 |
| 1248 | gnl|Fabrus|VH3-16__IGHD6-13*01__IGHJ4*01 | 844 | gnl|Fabrus|A2__IGKJ1*01 | 1076 |
| 1249 | gnl|Fabrus|VH3-23__IGHD1-1*01__IGHJ4*01 | 863 | gnl|Fabrus|HerceptinLC | 1086 |
| 1250 | gnl|Fabrus|VH3-23__IGHD2-15*01__IGHJ4*01 | 866 | gnl|Fabrus|HerceptinLC | 1086 |
| 1251 | gnl|Fabrus|VH3-23__IGHD3-22*01__IGHJ4*01 | 870 | gnl|Fabrus|HerceptinLC | 1086 |
| 1252 | gnl|Fabrus|VH3-23__IGHD4-11*01__IGHJ4*01 | 872 | gnl|Fabrus|HerceptinLC | 1086 |
| 1253 | gnl|Fabrus|VH3-23__IGHD5-12*01__IGHJ4*01 | 874 | gnl|Fabrus|HerceptinLC | 1086 |
| 1254 | gnl|Fabrus|VH3-23__IGHD5-5*01__IGHJ4*01 | 876 | gnl|Fabrus|HerceptinLC | 1086 |
| 1255 | gnl|Fabrus|VH3-23__IGHD6-13*01__IGHJ4*01 | 877 | gnl|Fabrus|HerceptinLC | 1086 |
| 1256 | gnl|Fabrus|VH3-23__IGHD7-27*01__IGHJ4*01 | 880 | gnl|Fabrus|HerceptinLC | 1086 |
| 1257 | gnl|Fabrus|VH3-23__IGHD7-27*01__IGHJ6*01 | 881 | gnl|Fabrus|HerceptinLC | 1086 |
| 1258 | gnl|Fabrus|VH1-69__IGHD1-14*01__IGHJ4*01 | 770 | gnl|Fabrus|HerceptinLC | 1086 |
| 1259 | gnl|Fabrus|VH1-69__IGHD2-2*01__IGHJ4*01 | 771 | gnl|Fabrus|HerceptinLC | 1086 |
| 1260 | gnl|Fabrus|VH1-69__IGHD2-8*01__IGHJ6*01 | 772 | gnl|Fabrus|HerceptinLC | 1086 |
| 1261 | gnl|Fabrus|VH1-69__IGHD3-16*01__IGHJ4*01 | 773 | gnl|Fabrus|HerceptinLC | 1086 |
| 1262 | gnl|Fabrus|VH1-69__IGHD3-3*01__IGHJ4*01 | 774 | gnl|Fabrus|HerceptinLC | 1086 |
| 1263 | gnl|Fabrus|VH1-69__IGHD4-17*01__IGHJ4*01 | 776 | gnl|Fabrus|HerceptinLC | 1086 |
| 1264 | gnl|Fabrus|VH1-69__IGHD5-12*01__IGHJ4*01 | 777 | gnl|Fabrus|HerceptinLC | 1086 |
| 1265 | gnl|Fabrus|VH1-69__IGHD6-19*01__IGHJ4*01 | 779 | gnl|Fabrus|HerceptinLC | 1086 |
| 1266 | gnl|Fabrus|VH1-69__IGHD7-27*01__IGHJ4*01 | 781 | gnl|Fabrus|HerceptinLC | 1086 |
| 1267 | gnl|Fabrus|VH4-34__IGHD1-7*01__IGHJ4*01 | 1017 | gnl|Fabrus|HerceptinLC | 1086 |
| 1268 | gnl|Fabrus|VH4-34__IGHD2-2*01__IGHJ4*01 | 1018 | gnl|Fabrus|HerceptinLC | 1086 |
| 1269 | gnl|Fabrus|VH4-34__IGHD3-16*01__IGHJ4*01 | 1019 | gnl|Fabrus|HerceptinLC | 1086 |
| 1270 | gnl|Fabrus|VH4-34__IGHD4-17*01__IGHJ4*01 | 1021 | gnl|Fabrus|HerceptinLC | 1086 |
| 1271 | gnl|Fabrus|VH4-34__IGHD5-12*01__IGHJ4*01 | 1022 | gnl|Fabrus|HerceptinLC | 1086 |
| 1272 | gnl|Fabrus|VH4-34__IGHD6-13*01__IGHJ4*01 | 1023 | gnl|Fabrus|HerceptinLC | 1086 |
| 1273 | gnl|Fabrus|VH4-34__IGHD6-25*01__IGHJ6*01 | 1024 | gnl|Fabrus|HerceptinLC | 1086 |
| 1274 | gnl|Fabrus|VH4-34__IGHD7-27*01__IGHJ4*01 | 1026 | gnl|Fabrus|HerceptinLC | 1086 |
| 1275 | gnl|Fabrus|VH2-26__IGHD1-20*01__IGHJ4*01 | 789 | gnl|Fabrus|HerceptinLC | 1086 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1276 | gnl|Fabrus|VH2-26__IGHD2-2*01__IGHJ4*01 | 791 | gnl|Fabrus|HerceptinLC | 1086 |
| 1277 | gnl|Fabrus|VH2-26__IGHD3-10*01__IGHJ4*01 | 792 | gnl|Fabrus|HerceptinLC | 1086 |
| 1278 | gnl|Fabrus|VH2-26__IGHD4-11*01__IGHJ4*01 | 794 | gnl|Fabrus|HerceptinLC | 1086 |
| 1279 | gnl|Fabrus|VH2-26__IGHD5-18*01__IGHJ4*01 | 796 | gnl|Fabrus|HerceptinLC | 1086 |
| 1280 | gnl|Fabrus|VH2-26__IGHD6-13*01__IGHJ4*01 | 797 | gnl|Fabrus|HerceptinLC | 1086 |
| 1281 | gnl|Fabrus|VH2-26__IGHD7-27*01__IGHJ4*01 | 798 | gnl|Fabrus|HerceptinLC | 1086 |
| 1282 | gnl|Fabrus|VH5-51__IGHD1-14*01__IGHJ4*01 | 1044 | gnl|Fabrus|HerceptinLC | 1086 |
| 1283 | gnl|Fabrus|VH5-51__IGHD2-8*01__IGHJ4*01 | 1046 | gnl|Fabrus|HerceptinLC | 1086 |
| 1284 | gnl|Fabrus|VH5-51__IGHD3-3*01__IGHJ4*01 | 1048 | gnl|Fabrus|HerceptinLC | 1086 |
| 1285 | gnl|Fabrus|VH5-51__IGHD4-17*01__IGHJ4*01 | 1049 | gnl|Fabrus|HerceptinLC | 1086 |
| 1286 | gnl|Fabrus|VH5-51__IGHD5-18*01__IGHJ4*01 | 1050 | gnl|Fabrus|HerceptinLC | 1086 |
| 1287 | gnl|Fabrus|VH5-51__IGHD5-18*01__IGHJ4*01 | 1051 | gnl|Fabrus|HerceptinLC | 1086 |
| 1288 | gnl|Fabrus|VH5-51__IGHD6-25*01__IGHJ4*01 | 1052 | gnl|Fabrus|HerceptinLC | 1086 |
| 1289 | gnl|Fabrus|VH5-51__IGHD7-27*01__IGHJ4*01 | 1053 | gnl|Fabrus|HerceptinLC | 1086 |
| 1290 | gnl|Fabrus|VH6-1__IGHD1-1*01__IGHJ4*01 | 1054 | gnl|Fabrus|HerceptinLC | 1086 |
| 1291 | gnl|Fabrus|VH6-1__IGHD2-15*01__IGHJ4*01 | 1056 | gnl|Fabrus|HerceptinLC | 1086 |
| 1292 | gnl|Fabrus|VH6-1__IGHD3-3*01__IGHJ4*01 | 1059 | gnl|Fabrus|HerceptinLC | 1086 |
| 1293 | gnl|Fabrus|VH6-1__IGHD4-23*01__IGHJ4*01 | 1061 | gnl|Fabrus|HerceptinLC | 1086 |
| 1294 | gnl|Fabrus|VH6-1__IGHD4-11*01__IGHJ6*01 | 1060 | gnl|Fabrus|HerceptinLC | 1086 |
| 1295 | gnl|Fabrus|VH6-1__IGHD5-5*01__IGHJ4*01 | 1062 | gnl|Fabrus|HerceptinLC | 1086 |
| 1296 | gnl|Fabrus|VH6-1__IGHD6-13*01__IGHJ4*01 | 1063 | gnl|Fabrus|HerceptinLC | 1086 |
| 1297 | gnl|Fabrus|VH6-1__IGHD6-25*01__IGHJ6*01 | 1064 | gnl|Fabrus|HerceptinLC | 1086 |
| 1298 | gnl|Fabrus|VH6-1__IGHD7-27*01__IGHJ4*01 | 1065 | gnl|Fabrus|HerceptinLC | 1086 |
| 1299 | gnl|Fabrus|VH4-59__IGHD6-25*01__IGHJ3*01 | 1043 | gnl|Fabrus|HerceptinLC | 1086 |
| 1300 | gnl|Fabrus|VH3-48__IGHD6-6*01__IGHJ1*01 | 923 | gnl|Fabrus|HerceptinLC | 1086 |
| 1301 | gnl|Fabrus|VH3-30__IGHD6-6*01__IGHJ1*01 | 893 | gnl|Fabrus|HerceptinLC | 1086 |
| 1302 | gnl|Fabrus|VH3-66__IGHD6-6*01__IGHJ1*01 | 949 | gnl|Fabrus|HerceptinLC | 1086 |
| 1303 | gnl|Fabrus|VH3-53__IGHD5-5*01__IGHJ4*01 | 938 | gnl|Fabrus|HerceptinLC | 1086 |
| 1304 | gnl|Fabrus|VH2-5__IGHD5-12*01__IGHJ4*01 | 804 | gnl|Fabrus|HerceptinLC | 1086 |
| 1305 | gnl|Fabrus|VH2-70__IGHD5-12*01__IGHJ4*01 | 811 | gnl|Fabrus|HerceptinLC | 1086 |
| 1306 | gnl|Fabrus|VH3-15__IGHD5-12*01__IGHJ4*01 | 835 | gnl|Fabrus|HerceptinLC | 1086 |
| 1307 | gnl|Fabrus|VH3-15__IGHD3-10*01__IGHJ4*01 | 833 | gnl|Fabrus|HerceptinLC | 1086 |
| 1308 | gnl|Fabrus|VH3-49__IGHD5-18*01__IGHJ4*01 | 930 | gnl|Fabrus|HerceptinLC | 1086 |
| 1309 | gnl|Fabrus|VH3-49__IGHD6-13*01__IGHJ4*01 | 931 | gnl|Fabrus|HerceptinLC | 1086 |
| 1310 | gnl|Fabrus|VH3-72__IGHD5-18*01__IGHJ4*01 | 967 | gnl|Fabrus|HerceptinLC | 1086 |
| 1311 | gnl|Fabrus|VH3-72__IGHD6-6*01__IGHJ1*01 | 969 | gnl|Fabrus|HerceptinLC | 1086 |
| 1312 | gnl|Fabrus|VH3-73__IGHD5-12*01__IGHJ4*01 | 977 | gnl|Fabrus|HerceptinLC | 1086 |
| 1313 | gnl|Fabrus|VH3-73__IGHD4-23*01__IGHJ5*01 | 976 | gnl|Fabrus|HerceptinLC | 1086 |
| 1314 | gnl|Fabrus|VH3-43__IGHD3-22*01__IGHJ4*01 | 918 | gnl|Fabrus|HerceptinLC | 1086 |
| 1315 | gnl|Fabrus|VH3-43__IGHD6-13*01__IGHJ4*01 | 921 | gnl|Fabrus|HerceptinLC | 1086 |
| 1316 | gnl|Fabrus|VH3-9__IGHD3-22*01__IGHJ4*01 | 992 | gnl|Fabrus|HerceptinLC | 1086 |
| 1317 | gnl|Fabrus|VH3-9__IGHD1-7*01__IGHJ5*01 | 989 | gnl|Fabrus|HerceptinLC | 1086 |
| 1318 | gnl|Fabrus|VH3-9__IGHD6-13*01__IGHJ4*01 | 995 | gnl|Fabrus|HerceptinLC | 1086 |
| 1319 | gnl|Fabrus|VH4-39__IGHD3-10*01__IGHJ4*01 | 1030 | gnl|Fabrus|HerceptinLC | 1086 |
| 1320 | gnl|Fabrus|VH4-39__IGHD5-12*01__IGHJ4*01 | 1034 | gnl|Fabrus|HerceptinLC | 1086 |
| 1321 | gnl|Fabrus|VH1-18__IGHD6-6*01__IGHJ1*01 | 728 | gnl|Fabrus|HerceptinLC | 1086 |
| 1322 | gnl|Fabrus|VH1-24__IGHD5-12*01__IGHJ4*01 | 735 | gnl|Fabrus|HerceptinLC | 1086 |
| 1323 | gnl|Fabrus|VH1-2__IGHD1-1*01__IGHJ3*01 | 729 | gnl|Fabrus|HerceptinLC | 1086 |
| 1324 | gnl|Fabrus|VH1-3__IGHD6-6*01__IGHJ1*01 | 743 | gnl|Fabrus|HerceptinLC | 1086 |
| 1325 | gnl|Fabrus|VH1-45__IGHD3-10*01__IGHJ4*01 | 748 | gnl|Fabrus|HerceptinLC | 1086 |
| 1326 | gnl|Fabrus|VH1-46__IGHD1-26*01__IGHJ4*01 | 754 | gnl|Fabrus|HerceptinLC | 1086 |
| 1327 | gnl|Fabrus|VH7-81__IGHD2-21*01__IGHJ6*01 | 1068 | gnl|Fabrus|HerceptinLC | 1086 |
| 1328 | gnl|Fabrus|VH2-70__IGHD3-9*01__IGHJ6*01 | 810 | gnl|Fabrus|HerceptinLC | 1086 |
| 1329 | gnl|Fabrus|VH1-58__IGHD3-10*01__IGHJ6*01 | 764 | gnl|Fabrus|HerceptinLC | 1086 |
| 1330 | gnl|Fabrus|VH7-81__IGHD2-21*01__IGHJ2*01 | 1067 | gnl|Fabrus|HerceptinLC | 1086 |
| 1331 | gnl|Fabrus|VH4-28__IGHD3-9*01__IGHJ6*01 | 1002 | gnl|Fabrus|HerceptinLC | 1086 |
| 1332 | gnl|Fabrus|VH4-31__IGHD2-15*01__IGHJ2*01 | 1008 | gnl|Fabrus|HerceptinLC | 1086 |
| 1333 | gnl|Fabrus|VH2-5__IGHD3-9*01__IGHJ6*01 | 803 | gnl|Fabrus|HerceptinLC | 1086 |
| 1334 | gnl|Fabrus|VH1-8__IGHD2-15*01__IGHJ6*01 | 783 | gnl|Fabrus|HerceptinLC | 1086 |
| 1335 | gnl|Fabrus|VH2-70__IGHD2-15*01__IGHJ2*01 | 808 | gnl|Fabrus|HerceptinLC | 1086 |
| 1336 | gnl|Fabrus|VH3-38__IGHD3-10*01__IGHJ4*01 | 907 | gnl|Fabrus|HerceptinLC | 1086 |
| 1337 | gnl|Fabrus|VH3-16__IGHD1-7*01__IGHJ6*01 | 838 | gnl|Fabrus|HerceptinLC | 1086 |
| 1338 | gnl|Fabrus|VH3-73__IGHD3-9*01__IGHJ6*01 | 974 | gnl|Fabrus|HerceptinLC | 1086 |
| 1339 | gnl|Fabrus|VH3-11__IGHD3-9*01__IGHJ6*01 | 816 | gnl|Fabrus|HerceptinLC | 1086 |
| 1340 | gnl|Fabrus|VH3-11__IGHD6-6*01__IGHJ1*01 | 820 | gnl|Fabrus|HerceptinLC | 1086 |
| 1341 | gnl|Fabrus|VH3-20__IGHD5-12*01__IGHJ4*01 | 852 | gnl|Fabrus|HerceptinLC | 1086 |
| 1342 | gnl|Fabrus|VH3-16__IGHD2-15*01__IGHJ2*01 | 839 | gnl|Fabrus|HerceptinLC | 1086 |
| 1343 | gnl|Fabrus|VH3-7__IGHD6-6*01__IGHJ1*01 | 960 | gnl|Fabrus|HerceptinLC | 1086 |
| 1344 | gnl|Fabrus|VH3-16__IGHD6-13*01__IGHJ4*01 | 844 | gnl|Fabrus|HerceptinLC | 1086 |
| 1345 | gnl|Fabrus|VH3-23__IGHD3-10*01__IGHJ4*01 | 868 | gnl|Fabrus|O12__IGKJ1*01 | 1101 |
| 1346 | gnl|Fabrus|VH3-23__IGHD3-10*01__IGHJ4*01 | 868 | gnl|Fabrus|O18__IGKJ1*01 | 1102 |
| 1347 | gnl|Fabrus|VH3-23__IGHD3-10*01__IGHJ4*01 | 868 | gnl|Fabrus|A20__IGKJ1*01 | 1077 |
| 1348 | gnl|Fabrus|VH3-23__IGHD3-10*01__IGHJ4*01 | 868 | gnl|Fabrus|A30__IGKJ1*01 | 1082 |
| 1349 | gnl|Fabrus|VH3-23__IGHD3-10*01__IGHJ4*01 | 868 | gnl|Fabrus|L14__IGKJ1*01 | 1089 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1350 | gnl\|Fabrus\|VH3-23__IGHD3-10*01__IGHJ4*01 | 868 | gnl\|Fabrus\|L4/18a__IGKJ1*01 | 1095 |
| 1351 | gnl\|Fabrus\|VH3-23__IGHD3-10*01__IGHJ4*01 | 868 | gnl\|Fabrus\|L5__IGKJ1*01 | 1096 |
| 1352 | gnl\|Fabrus\|VH3-23__IGHD3-10*01__IGHJ4*01 | 868 | gnl\|Fabrus\|L8__IGKJ1*01 | 1097 |
| 1353 | gnl\|Fabrus\|VH3-23__IGHD3-10*01__IGHJ4*01 | 868 | gnl\|Fabrus\|L23__IGKJ1*01 | 1092 |
| 1354 | gnl\|Fabrus\|VH3-23__IGHD3-10*01__IGHJ4*01 | 868 | gnl\|Fabrus\|L11__IGKJ1*01 | 1087 |
| 1355 | gnl\|Fabrus\|VH3-23__IGHD3-10*01__IGHJ4*01 | 868 | gnl\|Fabrus\|L12__IGKJ1*01 | 1088 |
| 1356 | gnl\|Fabrus\|VH3-23__IGHD3-10*01__IGHJ4*01 | 868 | gnl\|Fabrus\|O1__IGKJ1*01 | 1100 |
| 1357 | gnl\|Fabrus\|VH3-23__IGHD3-10*01__IGHJ4*01 | 868 | gnl\|Fabrus\|A17__IGKJ1*01 | 1075 |
| 1358 | gnl\|Fabrus\|VH3-23__IGHD3-10*01__IGHJ4*01 | 868 | gnl\|Fabrus\|A2__IGKJ1*01 | 1076 |
| 1359 | gnl\|Fabrus\|VH3-23__IGHD3-10*01__IGHJ4*01 | 868 | gnl\|Fabrus\|A23__IGKJ1*01 | 1078 |
| 1360 | gnl\|Fabrus\|VH3-23__IGHD3-10*01__IGHJ4*01 | 868 | gnl\|Fabrus\|A27__IGKJ3*01 | 1081 |
| 1361 | gnl\|Fabrus\|VH3-23__IGHD3-10*01__IGHJ4*01 | 868 | gnl\|Fabrus\|L2__IGKJ1*01 | 1090 |
| 1362 | gnl\|Fabrus\|VH3-23__IGHD3-10*01__IGHJ4*01 | 868 | gnl\|Fabrus\|L6__IGKJ1*01 | 1097 |
| 1363 | gnl\|Fabrus\|VH3-23__IGHD3-10*01__IGHJ4*01 | 868 | gnl\|Fabrus\|L25__IGKJ1*01 | 1094 |
| 1364 | gnl\|Fabrus\|VH3-23__IGHD3-10*01__IGHJ4*01 | 868 | gnl\|Fabrus\|B3__IGKJ1*01 | 1085 |
| 1365 | gnl\|Fabrus\|VH3-23__IGHD3-10*01__IGHJ4*01 | 868 | gnl\|Fabrus\|B2__IGKJ1*01 | 1083 |
| 1366 | gnl\|Fabrus\|VH3-23__IGHD3-10*01__IGHJ4*01 | 868 | gnl\|Fabrus\|A26__IGKJ1*01 | 1079 |
| 1367 | gnl\|Fabrus\|VH3-23__IGHD3-10*01__IGHJ4*01 | 868 | gnl\|Fabrus\|A14__IGKJ1*01 | 1074 |
| 1368 | gnl\|Fabrus\|VH3-23__IGHD3-10*01__IGHJ4*01 | 868 | gnl\|Fabrus\|L9__IGKJ2*01 | 1099 |
| 1369 | gnl\|Fabrus\|VH3-23__IGHD3-10*01__IGHJ4*01 | 868 | gnl\|Fabrus\|A27__IGKJ1*01 | 1080 |
| 1370 | gnl\|Fabrus\|VH3-23__IGHD3-10*01__IGHJ4*01 | 868 | gnl\|Fabrus\|B2__IGKJ3*01 | 1084 |
| 1371 | gnl\|Fabrus\|VH3-23__IGHD3-10*01__IGHJ4*01 | 868 | gnl\|Fabrus\|L25__IGKJ3*01 | 1094 |
| 1372 | gnl\|Fabrus\|VH3-23__IGHD3-10*01__IGHJ4*01 | 868 | gnl\|Fabrus\|RituxanLC | 1103 |
| 1373 | gnl\|Fabrus\|VH3-23__IGHD3-10*01__IGHJ4*01 | 868 | gnl\|Fabrus\|L22__IGKJ3*01 | 1091 |
| 1374 | gnl\|Fabrus\|VH3-23__IGHD3-10*01__IGHJ4*01 | 868 | gnl\|Fabrus\|HerceptinLC | 1086 |
| 1375 | gnl\|Fabrus\|VH4-31__IGHD6-6*01__IGHJ1*01 | 1015 | gnl\|Fabrus\|O12__IGKJ1*01 | 1101 |
| 1376 | gnl\|Fabrus\|VH4-31__IGHD6-6*01__IGHJ1*01 | 1015 | gnl\|Fabrus\|O18__IGKJ1*01 | 1102 |
| 1377 | gnl\|Fabrus\|VH4-31__IGHD6-6*01__IGHJ1*01 | 1015 | gnl\|Fabrus\|A20__IGKJ1*01 | 1077 |
| 1378 | gnl\|Fabrus\|VH4-31__IGHD6-6*01__IGHJ1*01 | 1015 | gnl\|Fabrus\|A30__IGKJ1*01 | 1082 |
| 1379 | gnl\|Fabrus\|VH4-31__IGHD6-6*01__IGHJ1*01 | 1015 | gnl\|Fabrus\|L14__IGKJ1*01 | 1089 |
| 1380 | gnl\|Fabrus\|VH4-31__IGHD6-6*01__IGHJ1*01 | 1015 | gnl\|Fabrus\|L4/18a__IGKJ1*01 | 1095 |
| 1381 | gnl\|Fabrus\|VH4-31__IGHD6-6*01__IGHJ1*01 | 1015 | gnl\|Fabrus\|L5__IGKJ1*01 | 1096 |
| 1382 | gnl\|Fabrus\|VH4-31__IGHD6-6*01__IGHJ1*01 | 1015 | gnl\|Fabrus\|L8__IGKJ1*01 | 1097 |
| 1383 | gnl\|Fabrus\|VH4-31__IGHD6-6*01__IGHJ1*01 | 1015 | gnl\|Fabrus\|L23__IGKJ1*01 | 1092 |
| 1384 | gnl\|Fabrus\|VH4-31__IGHD6-6*01__IGHJ1*01 | 1015 | gnl\|Fabrus\|L11__IGKJ1*01 | 1087 |
| 1385 | gnl\|Fabrus\|VH4-31__IGHD6-6*01__IGHJ1*01 | 1015 | gnl\|Fabrus\|L12__IGKJ1*01 | 1088 |
| 1386 | gnl\|Fabrus\|VH4-31__IGHD6-6*01__IGHJ1*01 | 1015 | gnl\|Fabrus\|O1__IGKJ1*01 | 1100 |
| 1387 | gnl\|Fabrus\|VH4-31__IGHD6-6*01__IGHJ1*01 | 1015 | gnl\|Fabrus\|A17__IGKJ1*01 | 1075 |
| 1388 | gnl\|Fabrus\|VH4-31__IGHD6-6*01__IGHJ1*01 | 1015 | gnl\|Fabrus\|A2__IGKJ1*01 | 1076 |
| 1389 | gnl\|Fabrus\|VH4-31__IGHD6-6*01__IGHJ1*01 | 1015 | gnl\|Fabrus\|A23__IGKJ1*01 | 1078 |
| 1390 | gnl\|Fabrus\|VH4-31__IGHD6-6*01__IGHJ1*01 | 1015 | gnl\|Fabrus\|A27__IGKJ3*01 | 1081 |
| 1391 | gnl\|Fabrus\|VH4-31__IGHD6-6*01__IGHJ1*01 | 1015 | gnl\|Fabrus\|L2__IGKJ1*01 | 1090 |
| 1392 | gnl\|Fabrus\|VH4-31__IGHD6-6*01__IGHJ1*01 | 1015 | gnl\|Fabrus\|L6__IGKJ1*01 | 1097 |
| 1393 | gnl\|Fabrus\|VH4-31__IGHD6-6*01__IGHJ1*01 | 1015 | gnl\|Fabrus\|L25__IGKJ1*01 | 1094 |
| 1394 | gnl\|Fabrus\|VH4-31__IGHD6-6*01__IGHJ1*01 | 1015 | gnl\|Fabrus\|B3__IGKJ1*01 | 1085 |
| 1395 | gnl\|Fabrus\|VH4-31__IGHD6-6*01__IGHJ1*01 | 1015 | gnl\|Fabrus\|B2__IGKJ1*01 | 1083 |
| 1396 | gnl\|Fabrus\|VH4-31__IGHD6-6*01__IGHJ1*01 | 1015 | gnl\|Fabrus\|A26__IGKJ1*01 | 1079 |
| 1397 | gnl\|Fabrus\|VH4-31__IGHD6-6*01__IGHJ1*01 | 1015 | gnl\|Fabrus\|A14__IGKJ1*01 | 1074 |
| 1398 | gnl\|Fabrus\|VH4-31__IGHD6-6*01__IGHJ1*01 | 1015 | gnl\|Fabrus\|L9__IGKJ2*01 | 1099 |
| 1399 | gnl\|Fabrus\|VH4-31__IGHD6-6*01__IGHJ1*01 | 1015 | gnl\|Fabrus\|A27__IGKJ1*01 | 1080 |
| 1400 | gnl\|Fabrus\|VH4-31__IGHD6-6*01__IGHJ1*01 | 1015 | gnl\|Fabrus\|B2__IGKJ3*01 | 1084 |
| 1401 | gnl\|Fabrus\|VH4-31__IGHD6-6*01__IGHJ1*01 | 1015 | gnl\|Fabrus\|L25__IGKJ3*01 | 1094 |
| 1402 | gnl\|Fabrus\|VH4-31__IGHD6-6*01__IGHJ1*01 | 1015 | gnl\|Fabrus\|RituxanLC | 1103 |
| 1403 | gnl\|Fabrus\|VH4-31__IGHD6-6*01__IGHJ1*01 | 1015 | gnl\|Fabrus\|L22__IGKJ3*01 | 1091 |
| 1404 | gnl\|Fabrus\|VH4-31__IGHD6-6*01__IGHJ1*01 | 1015 | gnl\|Fabrus\|HerceptinLC | 1086 |
| 1405 | gnl\|Fabrus\|RituxanHC | 721 | gnl\|Fabrus\|O12__IGKJ1*01 | 1101 |
| 1406 | gnl\|Fabrus\|RituxanHC | 721 | gnl\|Fabrus\|O18__IGKJ1*01 | 1102 |
| 1407 | gnl\|Fabrus\|RituxanHC | 721 | gnl\|Fabrus\|A20__IGKJ1*01 | 1077 |
| 1408 | gnl\|Fabrus\|RituxanHC | 721 | gnl\|Fabrus\|A30__IGKJ1*01 | 1082 |
| 1409 | gnl\|Fabrus\|RituxanHC | 721 | gnl\|Fabrus\|L14__IGKJ1*01 | 1089 |
| 1410 | gnl\|Fabrus\|RituxanHC | 721 | gnl\|Fabrus\|L4/18a__IGKJ1*01 | 1095 |
| 1411 | gnl\|Fabrus\|RituxanHC | 721 | gnl\|Fabrus\|L5__IGKJ1*01 | 1096 |
| 1412 | gnl\|Fabrus\|RituxanHC | 721 | gnl\|Fabrus\|L8__IGKJ1*01 | 1097 |
| 1413 | gnl\|Fabrus\|RituxanHC | 721 | gnl\|Fabrus\|L23__IGKJ1*01 | 1092 |
| 1414 | gnl\|Fabrus\|RituxanHC | 721 | gnl\|Fabrus\|L11__IGKJ1*01 | 1087 |
| 1415 | gnl\|Fabrus\|RituxanHC | 721 | gnl\|Fabrus\|L12__IGKJ1*01 | 1088 |
| 1416 | gnl\|Fabrus\|RituxanHC | 721 | gnl\|Fabrus\|O1__IGKJ1*01 | 1100 |
| 1417 | gnl\|Fabrus\|RituxanHC | 721 | gnl\|Fabrus\|A17__IGKJ1*01 | 1075 |
| 1418 | gnl\|Fabrus\|RituxanHC | 721 | gnl\|Fabrus\|A2__IGKJ1*01 | 1076 |
| 1419 | gnl\|Fabrus\|RituxanHC | 721 | gnl\|Fabrus\|A23__IGKJ1*01 | 1078 |
| 1420 | gnl\|Fabrus\|RituxanHC | 721 | gnl\|Fabrus\|A27__IGKJ3*01 | 1081 |
| 1421 | gnl\|Fabrus\|RituxanHC | 721 | gnl\|Fabrus\|L2__IGKJ1*01 | 1090 |
| 1422 | gnl\|Fabrus\|RituxanHC | 721 | gnl\|Fabrus\|L6__IGKJ1*01 | 1097 |
| 1423 | gnl\|Fabrus\|RituxanHC | 721 | gnl\|Fabrus\|L25__IGKJ1*01 | 1094 |

TABLE 4-continued

Exemplary Paired Nucleic Acid Library

| HEAVY CHAIN | SEQ ID NO | LIGHT CHAIN | SEQ ID NO |
|---|---|---|---|
| 1424 gnl\|Fabrus\|RituxanHC | 721 | gnl\|Fabrus\|B3__IGKJ1*01 | 1085 |
| 1425 gnl\|Fabrus\|RituxanHC | 721 | gnl\|Fabrus\|B2__IGKJ1*01 | 1083 |
| 1426 gnl\|Fabrus\|RituxanHC | 721 | gnl\|Fabrus\|A26__IGKJ1*01 | 1079 |
| 1427 gnl\|Fabrus\|RituxanHC | 721 | gnl\|Fabrus\|A14__IGKJ1*01 | 1074 |
| 1428 gnl\|Fabrus\|RituxanHC | 721 | gnl\|Fabrus\|L9__IGKJ2*01 | 1099 |
| 1429 gnl\|Fabrus\|RituxanHC | 721 | gnl\|Fabrus\|A27__IGKJ1*01 | 1080 |
| 1430 gnl\|Fabrus\|RituxanHC | 721 | gnl\|Fabrus\|B2__IGKJ3*01 | 1084 |
| 1431 gnl\|Fabrus\|RituxanHC | 721 | gnl\|Fabrus\|L25__IGKJ3*01 | 1094 |
| 1432 gnl\|Fabrus\|RituxanHC | 721 | gnl\|Fabrus\|RituxanLC | 1103 |
| 1433 gnl\|Fabrus\|RituxanHC | 721 | gnl\|Fabrus\|L22__IGKJ3*01 | 1091 |
| 1434 gnl\|Fabrus\|RituxanHC | 721 | gnl\|Fabrus\|HerceptinLC | 1086 |
| 1435 gnl\|Fabrus\|HerceptinHC | 720 | gnl\|Fabrus\|O12__IGKJ1*01 | 1101 |
| 1436 gnl\|Fabrus\|HerceptinHC | 720 | gnl\|Fabrus\|O18__IGKJ1*01 | 1102 |
| 1437 gnl\|Fabrus\|HerceptinHC | 720 | gnl\|Fabrus\|A20__IGKJ1*01 | 1077 |
| 1438 gnl\|Fabrus\|HerceptinHC | 720 | gnl\|Fabrus\|A30__IGKJ1*01 | 1082 |
| 1439 gnl\|Fabrus\|HerceptinHC | 720 | gnl\|Fabrus\|L14__IGKJ1*01 | 1089 |
| 1440 gnl\|Fabrus\|HerceptinHC | 720 | gnl\|Fabrus\|L4/18a__IGKJ1*01 | 1095 |
| 1441 gnl\|Fabrus\|HerceptinHC | 720 | gnl\|Fabrus\|L5__IGKJ1*01 | 1096 |
| 1442 gnl\|Fabrus\|HerceptinHC | 720 | gnl\|Fabrus\|L8__IGKJ1*01 | 1097 |
| 1443 gnl\|Fabrus\|HerceptinHC | 720 | gnl\|Fabrus\|L23__IGKJ1*01 | 1092 |
| 1444 gnl\|Fabrus\|HerceptinHC | 720 | gnl\|Fabrus\|L11__IGKJ1*01 | 1087 |
| 1445 gnl\|Fabrus\|HerceptinHC | 720 | gnl\|Fabrus\|L12__IGKJ1*01 | 1088 |
| 1446 gnl\|Fabrus\|HerceptinHC | 720 | gnl\|Fabrus\|O1__IGKJ1*01 | 1100 |
| 1447 gnl\|Fabrus\|HerceptinHC | 720 | gnl\|Fabrus\|A17__IGKJ1*01 | 1075 |
| 1448 gnl\|Fabrus\|HerceptinHC | 720 | gnl\|Fabrus\|A2__IGKJ1*01 | 1076 |
| 1449 gnl\|Fabrus\|HerceptinHC | 720 | gnl\|Fabrus\|A23__IGKJ1*01 | 1078 |
| 1450 gnl\|Fabrus\|HerceptinHC | 720 | gnl\|Fabrus\|A27__IGKJ3*01 | 1081 |
| 1451 gnl\|Fabrus\|HerceptinHC | 720 | gnl\|Fabrus\|L2__IGKJ1*01 | 1090 |
| 1452 gnl\|Fabrus\|HerceptinHC | 720 | gnl\|Fabrus\|L6__IGKJ1*01 | 1097 |
| 1453 gnl\|Fabrus\|HerceptinHC | 720 | gnl\|Fabrus\|L25__IGKJ1*01 | 1094 |
| 1454 gnl\|Fabrus\|HerceptinHC | 720 | gnl\|Fabrus\|B3__IGKJ1*01 | 1085 |
| 1455 gnl\|Fabrus\|HerceptinHC | 720 | gnl\|Fabrus\|B2__IGKJ1*01 | 1083 |
| 1456 gnl\|Fabrus\|HerceptinHC | 720 | gnl\|Fabrus\|A26__IGKJ1*01 | 1079 |
| 1457 gnl\|Fabrus\|HerceptinHC | 720 | gnl\|Fabrus\|A14__IGKJ1*01 | 1074 |
| 1458 gnl\|Fabrus\|HerceptinHC | 720 | gnl\|Fabrus\|L9__IGKJ2*01 | 1099 |
| 1459 gnl\|Fabrus\|HerceptinHC | 720 | gnl\|Fabrus\|A27__IGKJ1*01 | 1080 |
| 1460 gnl\|Fabrus\|HerceptinHC | 720 | gnl\|Fabrus\|B2__IGKJ3*01 | 1084 |
| 1461 gnl\|Fabrus\|HerceptinHC | 720 | gnl\|Fabrus\|L25__IGKJ3*01 | 1094 |
| 1462 gnl\|Fabrus\|HerceptinHC | 720 | gnl\|Fabrus\|RituxanLC | 1103 |
| 1463 gnl\|Fabrus\|HerceptinHC | 720 | gnl\|Fabrus\|L22__IGKJ3*01 | 1091 |
| 1464 gnl\|Fabrus\|HerceptinHC | 720 | gnl\|Fabrus\|HerceptinLC | 1086 |
| 1465 VH3-23__IGHD1-1*01 > 1__IGHJ1*01 | 1136 | gnl\|Fabrus\|O12__IGKJ1*01 | 1101 |
| 1466 VH3-23__IGHD1-1*01 > 2__IGHJ1*01 | 1137 | gnl\|Fabrus\|O12__IGKJ1*01 | 1101 |
| 1467 VH3-23__IGHD1-1*01 > 3__IGHJ1*01 | 1138 | gnl\|Fabrus\|O12__IGKJ1*01 | 1101 |
| 1468 VH3-23__IGHD1-7*01 > 1__IGHJ1*01 | 1139 | gnl\|Fabrus\|O12__IGKJ1*01 | 1101 |
| 1469 VH3-23__IGHD1-7*01 > 3__IGHJ1*01 | 1140 | gnl\|Fabrus\|O12__IGKJ1*01 | 1101 |
| 1470 VH3-23__IGHD1-14*01 > 1__IGHJ1*01 | 1141 | gnl\|Fabrus\|O12__IGKJ1*01 | 1101 |
| 1471 VH3-23__IGHD1-14*01 > 3__IGHJ1*01 | 1142 | gnl\|Fabrus\|O12__IGKJ1*01 | 1101 |
| 1472 VH3-23__IGHD1-20*01 > 1__IGHJ1*01 | 1143 | gnl\|Fabrus\|O12__IGKJ1*01 | 1101 |
| 1473 VH3-23__IGHD1-20*01 > 3__IGHJ1*01 | 1144 | gnl\|Fabrus\|O12__IGKJ1*01 | 1101 |
| 1474 VH3-23__IGHD1-26*01 > 1__IGHJ1*01 | 1145 | gnl\|Fabrus\|O12__IGKJ1*01 | 1101 |
| 1475 VH3-23__IGHD1-26*01 > 3__IGHJ1*01 | 1146 | gnl\|Fabrus\|O12__IGKJ1*01 | 1101 |
| 1476 VH3-23__IGHD2-2*01 > 2__IGHJ1*01 | 1147 | gnl\|Fabrus\|O12__IGKJ1*01 | 1101 |
| 1477 VH3-23__IGHD2-2*01 > 3__IGHJ1*01 | 1148 | gnl\|Fabrus\|O12__IGKJ1*01 | 1101 |
| 1478 VH3-23__IGHD2-8*01 > 2__IGHJ1*01 | 1149 | gnl\|Fabrus\|O12__IGKJ1*01 | 1101 |
| 1479 VH3-23__IGHD2-8*01 > 3__IGHJ1*01 | 1150 | gnl\|Fabrus\|O12__IGKJ1*01 | 1101 |
| 1480 VH3-23__IGHD2-15*01 > 2__IGHJ1*01 | 1151 | gnl\|Fabrus\|O12__IGKJ1*01 | 1101 |
| 1481 VH3-23__IGHD2-15*01 > 3__IGHJ1*01 | 1152 | gnl\|Fabrus\|O12__IGKJ1*01 | 1101 |
| 1482 VH3-23__IGHD2-21*01 > 2__IGHJ1*01 | 1153 | gnl\|Fabrus\|O12__IGKJ1*01 | 1101 |
| 1483 VH3-23__IGHD2-21*01 > 3__IGHJ1*01 | 1154 | gnl\|Fabrus\|O12__IGKJ1*01 | 1101 |
| 1484 VH3-23__IGHD3-3*01 > 1__IGHJ1*01 | 1155 | gnl\|Fabrus\|O12__IGKJ1*01 | 1101 |
| 1485 VH3-23__IGHD3-3*01 > 2__IGHJ1*01 | 1156 | gnl\|Fabrus\|O12__IGKJ1*01 | 1101 |
| 1486 VH3-23__IGHD3-3*01 > 3__IGHJ1*01 | 1157 | gnl\|Fabrus\|O12__IGKJ1*01 | 1101 |
| 1487 VH3-23__IGHD3-9*01 > 2__IGHJ1*01 | 1158 | gnl\|Fabrus\|O12__IGKJ1*01 | 1101 |
| 1488 VH3-23__IGHD3-10*01 > 2__IGHJ1*01 | 1159 | gnl\|Fabrus\|O12__IGKJ1*01 | 1101 |
| 1489 VH3-23__IGHD3-10*01 > 3__IGHJ1*01 | 1160 | gnl\|Fabrus\|O12__IGKJ1*01 | 1101 |
| 1490 VH3-23__IGHD3-16*01 > 2__IGHJ1*01 | 1161 | gnl\|Fabrus\|O12__IGKJ1*01 | 1101 |
| 1491 VH3-23__IGHD3-16*01 > 3__IGHJ1*01 | 1162 | gnl\|Fabrus\|O12__IGKJ1*01 | 1101 |
| 1492 VH3-23__IGHD3-22*01 > 2__IGHJ1*01 | 1163 | gnl\|Fabrus\|O12__IGKJ1*01 | 1101 |
| 1493 VH3-23__IGHD3-22*01 > 3__IGHJ1*01 | 1164 | gnl\|Fabrus\|O12__IGKJ1*01 | 1101 |
| 1494 VH3-23__IGHD4-4*01 (1) > 2__IGHJ1*01 | 1165 | gnl\|Fabrus\|O12__IGKJ1*01 | 1101 |
| 1495 VH3-23__IGHD4-4*01 (1) > 3__IGHJ1*01 | 1166 | gnl\|Fabrus\|O12__IGKJ1*01 | 1101 |
| 1496 VH3-23__IGHD4-11*01 (1) > 2__IGHJ1*01 | 1167 | gnl\|Fabrus\|O12__IGKJ1*01 | 1101 |
| 1497 VH3-23__IGHD4-11*01 (1) > 3__IGHJ1*01 | 1168 | gnl\|Fabrus\|O12__IGKJ1*01 | 1101 |

TABLE 4-continued

Exemplary Paired Nucleic Acid Library

| HEAVY CHAIN | SEQ ID NO | LIGHT CHAIN | SEQ ID NO |
|---|---|---|---|
| 1498 VH3-23_IGHD4-17*01 > 2_IGHJ1*01 | 1169 | gnl\|Fabrus\|O12_IGKJ1*01 | 1101 |
| 1499 VH3-23_IGHD4-17*01 > 3_IGHJ1*01 | 1170 | gnl\|Fabrus\|O12_IGKJ1*01 | 1101 |
| 1500 VH3-23_IGHD4-23*01 > 2_IGHJ1*01 | 1171 | gnl\|Fabrus\|O12_IGKJ1*01 | 1101 |
| 1501 VH3-23_IGHD4-23*01 > 3_IGHJ1*01 | 1172 | gnl\|Fabrus\|O12_IGKJ1*01 | 1101 |
| 1502 VH3-23_IGHD5-5*01 (2) > 1_IGHJ1*01 | 1173 | gnl\|Fabrus\|O12_IGKJ1*01 | 1101 |
| 1503 VH3-23_IGHD5-5*01 (2) > 2_IGHJ1*01 | 1174 | gnl\|Fabrus\|O12_IGKJ1*01 | 1101 |
| 1504 VH3-23_IGHD5-5*01 (2) > 3_IGHJ1*01 | 1175 | gnl\|Fabrus\|O12_IGKJ1*01 | 1101 |
| 1505 VH3-23_IGHD5-12*01 > 1_IGHJ1*01 | 1176 | gnl\|Fabrus\|O12_IGKJ1*01 | 1101 |
| 1506 VH3-23_IGHD5-12*01 > 3_IGHJ1*01 | 1177 | gnl\|Fabrus\|O12_IGKJ1*01 | 1101 |
| 1507 VH3-23_IGHD5-18*01 (2) > 1_IGHJ1*01 | 1178 | gnl\|Fabrus\|O12_IGKJ1*01 | 1101 |
| 1508 VH3-23_IGHD5-18*01 (2) > 2_IGHJ1*01 | 1179 | gnl\|Fabrus\|O12_IGKJ1*01 | 1101 |
| 1509 VH3-23_IGHD5-18*01 (2) > 3_IGHJ1*01 | 1180 | gnl\|Fabrus\|O12_IGKJ1*01 | 1101 |
| 1510 VH3-23_IGHD5-24*01 > 1_IGHJ1*01 | 1181 | gnl\|Fabrus\|O12_IGKJ1*01 | 1101 |
| 1511 VH3-23_IGHD5-24*01 > 3_IGHJ1*01 | 1182 | gnl\|Fabrus\|O12_IGKJ1*01 | 1101 |
| 1512 VH3-23_IGHD6-6*01 > 1_IGHJ1*01 | 1183 | gnl\|Fabrus\|O12_IGKJ1*01 | 1101 |
| 1513 VH3-23_IGHD1-1*01 > 1'_IGHJ1*01 | 1193 | gnl\|Fabrus\|O12_IGKJ1*01 | 1101 |
| 1514 VH3-23_IGHD1-1*01 > 2'_IGHJ1*01 | 1194 | gnl\|Fabrus\|O12_IGKJ1*01 | 1101 |
| 1515 VH3-23_IGHD1-1*01 > 3'_IGHJ1*01 | 1195 | gnl\|Fabrus\|O12_IGKJ1*01 | 1101 |
| 1516 VH3-23_IGHD1-7*01 > 1'_IGHJ1*01 | 1196 | gnl\|Fabrus\|O12_IGKJ1*01 | 1101 |
| 1517 VH3-23_IGHD1-7*01 > 3'_IGHJ1*01 | 1197 | gnl\|Fabrus\|O12_IGKJ1*01 | 1101 |
| 1518 VH3-23_IGHD1-14*01 > 1'_IGHJ1*01 | 1198 | gnl\|Fabrus\|O12_IGKJ1*01 | 1101 |
| 1519 VH3-23_IGHD1-14*01 > 2'_IGHJ1*01 | 1199 | gnl\|Fabrus\|O12_IGKJ1*01 | 1101 |
| 1520 VH3-23_IGHD1-14*01 > 3'_IGHJ1*01 | 1200 | gnl\|Fabrus\|O12_IGKJ1*01 | 1101 |
| 1521 VH3-23_IGHD1-20*01 > 1'_IGHJ1*01 | 1201 | gnl\|Fabrus\|O12_IGKJ1*01 | 1101 |
| 1522 VH3-23_IGHD1-20*01 > 2'_IGHJ1*01 | 1202 | gnl\|Fabrus\|O12_IGKJ1*01 | 1101 |
| 1523 VH3-23_IGHD1-20*01 > 3'_IGHJ1*01 | 1203 | gnl\|Fabrus\|O12_IGKJ1*01 | 1101 |
| 1524 VH3-23_IGHD1-26*01 > 1'_IGHJ1*01 | 1204 | gnl\|Fabrus\|O12_IGKJ1*01 | 1101 |
| 1525 VH3-23_IGHD1-26*01 > 3'_IGHJ1*01 | 1205 | gnl\|Fabrus\|O12_IGKJ1*01 | 1101 |
| 1526 VH3-23_IGHD2-2*01 > 1'_IGHJ1*01 | 1206 | gnl\|Fabrus\|O12_IGKJ1*01 | 1101 |
| 1527 VH3-23_IGHD2-2*01 > 3'_IGHJ1*01 | 1207 | gnl\|Fabrus\|O12_IGKJ1*01 | 1101 |
| 1528 VH3-23_IGHD2-8*01 > 1'_IGHJ1*01 | 1208 | gnl\|Fabrus\|O12_IGKJ1*01 | 1101 |
| 1529 VH3-23_IGHD2-15*01 > 1'_IGHJ1*01 | 1209 | gnl\|Fabrus\|O12_IGKJ1*01 | 1101 |
| 1530 VH3-23_IGHD2-15*01 > 3'_IGHJ1*01 | 1210 | gnl\|Fabrus\|O12_IGKJ1*01 | 1101 |
| 1531 VH3-23_IGHD2-21*01 > 1'_IGHJ1*01 | 1211 | gnl\|Fabrus\|O12_IGKJ1*01 | 1101 |
| 1532 VH3-23_IGHD2-21*01 > 3'_IGHJ1*01 | 1212 | gnl\|Fabrus\|O12_IGKJ1*01 | 1101 |
| 1533 VH3-23_IGHD3-3*01 > 1'_IGHJ1*01 | 1213 | gnl\|Fabrus\|O12_IGKJ1*01 | 1101 |
| 1534 VH3-23_IGHD3-3*01 > 3'_IGHJ1*01 | 1214 | gnl\|Fabrus\|O12_IGKJ1*01 | 1101 |
| 1535 VH3-23_IGHD3-9*01 > 1'_IGHJ1*01 | 1215 | gnl\|Fabrus\|O12_IGKJ1*01 | 1101 |
| 1536 VH3-23_IGHD3-9*01 > 3'_IGHJ1*01 | 1216 | gnl\|Fabrus\|O12_IGKJ1*01 | 1101 |
| 1537 VH3-23_IGHD3-10*01 > 1'_IGHJ1*01 | 1217 | gnl\|Fabrus\|O12_IGKJ1*01 | 1101 |
| 1538 VH3-23_IGHD3-10*01 > 3'_IGHJ1*01 | 1218 | gnl\|Fabrus\|O12_IGKJ1*01 | 1101 |
| 1539 VH3-23_IGHD3-16*01 > 1'_IGHJ1*01 | 1219 | gnl\|Fabrus\|O12_IGKJ1*01 | 1101 |
| 1540 VH3-23_IGHD3-16*01 > 3'_IGHJ1*01 | 1220 | gnl\|Fabrus\|O12_IGKJ1*01 | 1101 |
| 1541 VH3-23_IGHD3-22*01 > 1'_IGHJ1*01 | 1221 | gnl\|Fabrus\|O12_IGKJ1*01 | 1101 |
| 1542 VH3-23_IGHD4-4*01 (1) > 1'_IGHJ1*01 | 1222 | gnl\|Fabrus\|O12_IGKJ1*01 | 1101 |
| 1543 VH3-23_IGHD4-4*01 (1) > 3'_IGHJ1*01 | 1223 | gnl\|Fabrus\|O12_IGKJ1*01 | 1101 |
| 1544 VH3-23_IGHD4-11*01 (1) > 1'_IGHJ1*01 | 1224 | gnl\|Fabrus\|O12_IGKJ1*01 | 1101 |
| 1545 VH3-23_IGHD4-11*01 (1) > 3'_IGHJ1*01 | 1225 | gnl\|Fabrus\|O12_IGKJ1*01 | 1101 |
| 1546 VH3-23_IGHD4-17*01 > 1'_IGHJ1*01 | 1226 | gnl\|Fabrus\|O12_IGKJ1*01 | 1101 |
| 1547 VH3-23_IGHD4-17*01 > 3'_IGHJ1*01 | 1227 | gnl\|Fabrus\|O12_IGKJ1*01 | 1101 |
| 1548 VH3-23_IGHD4-23*01 > 1'_IGHJ1*01 | 1228 | gnl\|Fabrus\|O12_IGKJ1*01 | 1101 |
| 1549 VH3-23_IGHD4-23*01 > 3'_IGHJ1*01 | 1229 | gnl\|Fabrus\|O12_IGKJ1*01 | 1101 |
| 1550 VH3-23_IGHD5-5*01 (2) > 1'_IGHJ1*01 | 1230 | gnl\|Fabrus\|O12_IGKJ1*01 | 1101 |
| 1551 VH3-23_IGHD5-5*01 (2) > 3'_IGHJ1*01 | 1231 | gnl\|Fabrus\|O12_IGKJ1*01 | 1101 |
| 1552 VH3-23_IGHD5-12*01 > 1'_IGHJ1*01 | 1232 | gnl\|Fabrus\|O12_IGKJ1*01 | 1101 |
| 1553 VH3-23_IGHD5-12*01 > 3'_IGHJ1*01 | 1233 | gnl\|Fabrus\|O12_IGKJ1*01 | 1101 |
| 1554 VH3-23_IGHD5-18*01 (2) > 1'_IGHJ1*01 | 1234 | gnl\|Fabrus\|O12_IGKJ1*01 | 1101 |
| 1555 VH3-23_IGHD5-18*01 (2) > 3'_IGHJ1*01 | 1235 | gnl\|Fabrus\|O12_IGKJ1*01 | 1101 |
| 1556 VH3-23_IGHD5-24*01 > 1'_IGHJ1*01 | 1236 | gnl\|Fabrus\|O12_IGKJ1*01 | 1101 |
| 1557 VH3-23_IGHD5-24*01 > 3'_IGHJ1*01 | 1237 | gnl\|Fabrus\|O12_IGKJ1*01 | 1101 |
| 1558 VH3-23_IGHD6-6*01 > 1'_IGHJ1*01 | 1238 | gnl\|Fabrus\|O12_IGKJ1*01 | 1101 |
| 1559 VH3-23_IGHD6-6*01 > 2'_IGHJ1*01 | 1239 | gnl\|Fabrus\|O12_IGKJ1*01 | 1101 |
| 1560 VH3-23_IGHD6-6*01 > 3'_IGHJ1*01 | 1240 | gnl\|Fabrus\|O12_IGKJ1*01 | 1101 |
| 1561 VH3-23_IGHD6-6*01 > 2_IGHJ1*01 | 1184 | gnl\|Fabrus\|O12_IGKJ1*01 | 1101 |
| 1562 VH3-23_IGHD6-13*01 > 1_IGHJ1*01 | 1185 | gnl\|Fabrus\|O12_IGKJ1*01 | 1101 |
| 1563 VH3-23_IGHD6-13*01 > 2_IGHJ1*01 | 1186 | gnl\|Fabrus\|O12_IGKJ1*01 | 1101 |
| 1564 VH3-23_IGHD6-19*01 > 1_IGHJ1*01 | 1187 | gnl\|Fabrus\|O12_IGKJ1*01 | 1101 |
| 1565 VH3-23_IGHD6-19*01 > 2_IGHJ1*01 | 1188 | gnl\|Fabrus\|O12_IGKJ1*01 | 1101 |
| 1566 VH3-23_IGHD6-25*01 > 1_IGHJ1*01 | 1189 | gnl\|Fabrus\|O12_IGKJ1*01 | 1101 |
| 1567 VH3-23_IGHD6-25*01 > 2_IGHJ1*01 | 1190 | gnl\|Fabrus\|O12_IGKJ1*01 | 1101 |
| 1568 VH3-23_IGHD7-27*01 > 1_IGHJ1*01 | 1191 | gnl\|Fabrus\|O12_IGKJ1*01 | 1101 |
| 1569 VH3-23_IGHD7-27*01 > 3_IGHJ1*01 | 1192 | gnl\|Fabrus\|O12_IGKJ1*01 | 1101 |
| 1570 VH3-23_IGHD6-13*01 > 1'_IGHJ1*01 | 1241 | gnl\|Fabrus\|O12_IGKJ1*01 | 1101 |
| 1571 VH3-23_IGHD6-13*01 > 2'_IGHJ1*01 | 1242 | gnl\|Fabrus\|O12_IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1572 | VH3-23_IGHD6-13*01 > 2_IGHJ1*01_B | 1243 | gnl\|Fabrus\|O12_IGKJ1*01 | 1101 |
| 1573 | VH3-23_IGHD6-19*01 > 1'_IGHJ1*01 | 1244 | gnl\|Fabrus\|O12_IGKJ1*01 | 1101 |
| 1574 | VH3-23_IGHD6-19*01 > 2'_IGHJ1*01 | 1245 | gnl\|Fabrus\|O12_IGKJ1*01 | 1101 |
| 1575 | VH3-23_IGHD6-19*01 > 2_IGHJ1*01_B | 1246 | gnl\|Fabrus\|O12_IGKJ1*01 | 1101 |
| 1576 | VH3-23_IGHD6-25*01 > 1'_IGHJ1*01 | 1247 | gnl\|Fabrus\|O12_IGKJ1*01 | 1101 |
| 1577 | VH3-23_IGHD6-25*01 > 3'_IGHJ1*01 | 1248 | gnl\|Fabrus\|O12_IGKJ1*01 | 1101 |
| 1578 | VH3-23_IGHD7-27*01 > 1'_IGHJ1*01_B | 1249 | gnl\|Fabrus\|O12_IGKJ1*01 | 1101 |
| 1579 | VH3-23_IGHD7-27*01 > 2'_IGHJ1*01 | 1250 | gnl\|Fabrus\|O12_IGKJ1*01 | 1101 |
| 1580 | VH3-23_IGHD1-1*01 > 1_IGHJ2*01 | 1251 | gnl\|Fabrus\|O12_IGKJ1*01 | 1101 |
| 1581 | VH3-23_IGHD1-1*01 > 2_IGHJ2*01 | 1252 | gnl\|Fabrus\|O12_IGKJ1*01 | 1101 |
| 1582 | VH3-23_IGHD1-1*01 > 3_IGHJ2*01 | 1253 | gnl\|Fabrus\|O12_IGKJ1*01 | 1101 |
| 1583 | VH3-23_IGHD1-7*01 > 1_IGHJ2*01 | 1254 | gnl\|Fabrus\|O12_IGKJ1*01 | 1101 |
| 1584 | VH3-23_IGHD1-7*01 > 3_IGHJ2*01 | 1255 | gnl\|Fabrus\|O12_IGKJ1*01 | 1101 |
| 1585 | VH3-23_IGHD1-14*01 > 1_IGHJ2*01 | 1256 | gnl\|Fabrus\|O12_IGKJ1*01 | 1101 |
| 1586 | VH3-23_IGHD1-14*01 > 3_IGHJ2*01 | 1257 | gnl\|Fabrus\|O12_IGKJ1*01 | 1101 |
| 1587 | VH3-23_IGHD1-20*01 > 1_IGHJ2*01 | 1258 | gnl\|Fabrus\|O12_IGKJ1*01 | 1101 |
| 1588 | VH3-23_IGHD1-20*01 > 3_IGHJ2*01 | 1259 | gnl\|Fabrus\|O12_IGKJ1*01 | 1101 |
| 1589 | VH3-23_IGHD1-26*01 > 1_IGHJ2*01 | 1260 | gnl\|Fabrus\|O12_IGKJ1*01 | 1101 |
| 1590 | VH3-23_IGHD1-26*01 > 3_IGHJ2*01 | 1261 | gnl\|Fabrus\|O12_IGKJ1*01 | 1101 |
| 1591 | VH3-23_IGHD2-2*01 > 2_IGHJ2*01 | 1262 | gnl\|Fabrus\|O12_IGKJ1*01 | 1101 |
| 1592 | VH3-23_IGHD2-2*01 > 3_IGHJ2*01 | 1263 | gnl\|Fabrus\|O12_IGKJ1*01 | 1101 |
| 1593 | VH3-23_IGHD2-8*01 > 2_IGHJ2*01 | 1264 | gnl\|Fabrus\|O12_IGKJ1*01 | 1101 |
| 1594 | VH3-23_IGHD2-8*01 > 3_IGHJ2*01 | 1265 | gnl\|Fabrus\|O12_IGKJ1*01 | 1101 |
| 1595 | VH3-23_IGHD2-15*01 > 2_IGHJ2*01 | 1266 | gnl\|Fabrus\|O12_IGKJ1*01 | 1101 |
| 1596 | VH3-23_IGHD2-15*01 > 3_IGHJ2*01 | 1267 | gnl\|Fabrus\|O12_IGKJ1*01 | 1101 |
| 1597 | VH3-23_IGHD2-21*01 > 2_IGHJ2*01 | 1268 | gnl\|Fabrus\|O12_IGKJ1*01 | 1101 |
| 1598 | VH3-23_IGHD2-21*01 > 3_IGHJ2*01 | 1269 | gnl\|Fabrus\|O12_IGKJ1*01 | 1101 |
| 1599 | VH3-23_IGHD3-3*01 > 1_IGHJ2*01 | 1270 | gnl\|Fabrus\|O12_IGKJ1*01 | 1101 |
| 1600 | VH3-23_IGHD3-3*01 > 2_IGHJ2*01 | 1271 | gnl\|Fabrus\|O12_IGKJ1*01 | 1101 |
| 1601 | VH3-23_IGHD3-3*01 > 3_IGHJ2*01 | 1272 | gnl\|Fabrus\|O12_IGKJ1*01 | 1101 |
| 1602 | VH3-23_IGHD3-9*01 > 2_IGHJ2*01 | 1273 | gnl\|Fabrus\|O12_IGKJ1*01 | 1101 |
| 1603 | VH3-23_IGHD3-10*01 > 2_IGHJ2*01 | 1274 | gnl\|Fabrus\|O12_IGKJ1*01 | 1101 |
| 1604 | VH3-23_IGHD3-10*01 > 3_IGHJ2*01 | 1275 | gnl\|Fabrus\|O12_IGKJ1*01 | 1101 |
| 1605 | VH3-23_IGHD3-16*01 > 2_IGHJ2*01 | 1276 | gnl\|Fabrus\|O12_IGKJ1*01 | 1101 |
| 1606 | VH3-23_IGHD3-16*01 > 3_IGHJ2*01 | 1277 | gnl\|Fabrus\|O12_IGKJ1*01 | 1101 |
| 1607 | VH3-23_IGHD3-22*01 > 2_IGHJ2*01 | 1278 | gnl\|Fabrus\|O12_IGKJ1*01 | 1101 |
| 1608 | VH3-23_IGHD3-22*01 > 3_IGHJ2*01 | 1279 | gnl\|Fabrus\|O12_IGKJ1*01 | 1101 |
| 1609 | VH3-23_IGHD4-4*01 (1) > 2_IGHJ2*01 | 1280 | gnl\|Fabrus\|O12_IGKJ1*01 | 1101 |
| 1610 | VH3-23_IGHD4-4*01 (1) > 3_IGHJ2*01 | 1281 | gnl\|Fabrus\|O12_IGKJ1*01 | 1101 |
| 1611 | VH3-23_IGHD4-11*01 (1) > 2_IGHJ2*01 | 1282 | gnl\|Fabrus\|O12_IGKJ1*01 | 1101 |
| 1612 | VH3-23_IGHD4-11*01 (1) > 3_IGHJ2*01 | 1283 | gnl\|Fabrus\|O12_IGKJ1*01 | 1101 |
| 1613 | VH3-23_IGHD4-17*01 > 2_IGHJ2*01 | 1284 | gnl\|Fabrus\|O12_IGKJ1*01 | 1101 |
| 1614 | VH3-23_IGHD4-17*01 > 3_IGHJ2*01 | 1285 | gnl\|Fabrus\|O12_IGKJ1*01 | 1101 |
| 1615 | VH3-23_IGHD4-23*01 > 2_IGHJ2*01 | 1286 | gnl\|Fabrus\|O12_IGKJ1*01 | 1101 |
| 1616 | VH3-23_IGHD4-23*01 > 3_IGHJ2*01 | 1287 | gnl\|Fabrus\|O12_IGKJ1*01 | 1101 |
| 1617 | VH3-23_IGHD5-5*01 (2) > 1_IGHJ2*01 | 1288 | gnl\|Fabrus\|O12_IGKJ1*01 | 1101 |
| 1618 | VH3-23_IGHD5-5*01 (2) > 2_IGHJ2*01 | 1289 | gnl\|Fabrus\|O12_IGKJ1*01 | 1101 |
| 1619 | VH3-23_IGHD5-5*01 (2) > 3_IGHJ2*01 | 1290 | gnl\|Fabrus\|O12_IGKJ1*01 | 1101 |
| 1620 | VH3-23_IGHD5-12*01 > 1_IGHJ2*01 | 1291 | gnl\|Fabrus\|O12_IGKJ1*01 | 1101 |
| 1621 | VH3-23_IGHD5-12*01 > 3_IGHJ2*01 | 1292 | gnl\|Fabrus\|O12_IGKJ1*01 | 1101 |
| 1622 | VH3-23_IGHD5-18*01 (2) > 1_IGHJ2*01 | 1293 | gnl\|Fabrus\|O12_IGKJ1*01 | 1101 |
| 1623 | VH3-23_IGHD5-18*01 (2) > 2_IGHJ2*01 | 1294 | gnl\|Fabrus\|O12_IGKJ1*01 | 1101 |
| 1624 | VH3-23_IGHD5-18*01 (2) > 3_IGHJ2*01 | 1295 | gnl\|Fabrus\|O12_IGKJ1*01 | 1101 |
| 1625 | VH3-23_IGHD5-24*01 > 1_IGHJ2*01 | 1296 | gnl\|Fabrus\|O12_IGKJ1*01 | 1101 |
| 1626 | VH3-23_IGHD5-24*01 > 3_IGHJ2*01 | 1297 | gnl\|Fabrus\|O12_IGKJ1*01 | 1101 |
| 1627 | VH3-23_IGHD6-6*01 > 1_IGHJ2*01 | 1298 | gnl\|Fabrus\|O12_IGKJ1*01 | 1101 |
| 1628 | VH3-23_IGHD1-1*01 > 1'_IGHJ2*01 | 1308 | gnl\|Fabrus\|O12_IGKJ1*01 | 1101 |
| 1629 | VH3-23_IGHD1-1*01 > 2'_IGHJ2*01 | 1309 | gnl\|Fabrus\|O12_IGKJ1*01 | 1101 |
| 1630 | VH3-23_IGHD1-1*01 > 3'_IGHJ2*01 | 1310 | gnl\|Fabrus\|O12_IGKJ1*01 | 1101 |
| 1631 | VH3-23_IGHD1-7*01 > 1'_IGHJ2*01 | 1311 | gnl\|Fabrus\|O12_IGKJ1*01 | 1101 |
| 1632 | VH3-23_IGHD1-7*01 > 3'_IGHJ2*01 | 1312 | gnl\|Fabrus\|O12_IGKJ1*01 | 1101 |
| 1633 | VH3-23_IGHD1-14*01 > 1'_IGHJ2*01 | 1313 | gnl\|Fabrus\|O12_IGKJ1*01 | 1101 |
| 1634 | VH3-23_IGHD1-14*01 > 2'_IGHJ2*01 | 1314 | gnl\|Fabrus\|O12_IGKJ1*01 | 1101 |
| 1635 | VH3-23_IGHD1-14*01 > 3'_IGHJ2*01 | 1315 | gnl\|Fabrus\|O12_IGKJ1*01 | 1101 |
| 1636 | VH3-23_IGHD1-20*01 > 1'_IGHJ2*01 | 1316 | gnl\|Fabrus\|O12_IGKJ1*01 | 1101 |
| 1637 | VH3-23_IGHD1-20*01 > 2'_IGHJ2*01 | 1317 | gnl\|Fabrus\|O12_IGKJ1*01 | 1101 |
| 1638 | VH3-23_IGHD1-20*01 > 3'_IGHJ2*01 | 1318 | gnl\|Fabrus\|O12_IGKJ1*01 | 1101 |
| 1639 | VH3-23_IGHD1-26*01 > 1'_IGHJ2*01 | 1319 | gnl\|Fabrus\|O12_IGKJ1*01 | 1101 |
| 1640 | VH3-23_IGHD1-26*01 > 1_IGHJ2*01_B | 1320 | gnl\|Fabrus\|O12_IGKJ1*01 | 1101 |
| 1641 | VH3-23_IGHD2-2*01 > 1'_IGHJ2*01 | 1321 | gnl\|Fabrus\|O12_IGKJ1*01 | 1101 |
| 1642 | VH3-23_IGHD2-2*01 > 3'_IGHJ2*01 | 1322 | gnl\|Fabrus\|O12_IGKJ1*01 | 1101 |
| 1643 | VH3-23_IGHD2-8*01 > 1'_IGHJ2*01 | 1323 | gnl\|Fabrus\|O12_IGKJ1*01 | 1101 |
| 1644 | VH3-23_IGHD2-15*01 > 1'_IGHJ2*01 | 1324 | gnl\|Fabrus\|O12_IGKJ1*01 | 1101 |
| 1645 | VH3-23_IGHD2-15*01 > 3'_IGHJ2*01 | 1325 | gnl\|Fabrus\|O12_IGKJ1*01 | 1101 |

TABLE 4-continued

Exemplary Paired Nucleic Acid Library

| HEAVY CHAIN | SEQ ID NO | LIGHT CHAIN | SEQ ID NO |
|---|---|---|---|
| 1646 VH3-23_IGHD2-21*01 > 1'_IGHJ2*01 | 1326 | gnl\|Fabrus\|O12_IGKJ1*01 | 1101 |
| 1647 VH3-23_IGHD2-21*01 > 3'_IGHJ2*01 | 1327 | gnl\|Fabrus\|O12_IGKJ1*01 | 1101 |
| 1648 VH3-23_IGHD3-3*01 > 1'_IGHJ2*01 | 1328 | gnl\|Fabrus\|O12_IGKJ1*01 | 1101 |
| 1649 VH3-23_IGHD3-3*01 > 3'_IGHJ2*01 | 1329 | gnl\|Fabrus\|O12_IGKJ1*01 | 1101 |
| 1650 VH3-23_IGHD3-9*01 > 1'_IGHJ2*01 | 1330 | gnl\|Fabrus\|O12_IGKJ1*01 | 1101 |
| 1651 VH3-23_IGHD3-9*01 > 3'_IGHJ2*01 | 1331 | gnl\|Fabrus\|O12_IGKJ1*01 | 1101 |
| 1652 VH3-23_IGHD3-10*01 > 1'_IGHJ2*01 | 1332 | gnl\|Fabrus\|O12_IGKJ1*01 | 1101 |
| 1653 VH3-23_IGHD3-10*01 > 3'_IGHJ2*01 | 1333 | gnl\|Fabrus\|O12_IGKJ1*01 | 1101 |
| 1654 VH3-23_IGHD3-16*01 > 1'_IGHJ2*01 | 1334 | gnl\|Fabrus\|O12_IGKJ1*01 | 1101 |
| 1655 VH3-23_IGHD3-16*01 > 3'_IGHJ2*01 | 1335 | gnl\|Fabrus\|O12_IGKJ1*01 | 1101 |
| 1656 VH3-23_IGHD3-22*01 > 1'_IGHJ2*01 | 1336 | gnl\|Fabrus\|O12_IGKJ1*01 | 1101 |
| 1657 VH3-23_IGHD4-4*01 (1) > 1'_IGHJ2*01 | 1337 | gnl\|Fabrus\|O12_IGKJ1*01 | 1101 |
| 1658 VH3-23_IGHD4-4*01 (1) > 3'_IGHJ2*01 | 1338 | gnl\|Fabrus\|O12_IGKJ1*01 | 1101 |
| 1659 VH3-23_IGHD4-11*01 (1) > 1'_IGHJ2*01 | 1339 | gnl\|Fabrus\|O12_IGKJ1*01 | 1101 |
| 1660 VH3-23_IGHD4-11*01 (1) > 3'_IGHJ2*01 | 1340 | gnl\|Fabrus\|O12_IGKJ1*01 | 1101 |
| 1661 VH3-23_IGHD4-17*01 > 1'_IGHJ2*01 | 1341 | gnl\|Fabrus\|O12_IGKJ1*01 | 1101 |
| 1662 VH3-23_IGHD4-17*01 > 3'_IGHJ2*01 | 1342 | gnl\|Fabrus\|O12_IGKJ1*01 | 1101 |
| 1663 VH3-23_IGHD4-23*01 > 1'_IGHJ2*01 | 1343 | gnl\|Fabrus\|O12_IGKJ1*01 | 1101 |
| 1664 VH3-23_IGHD4-23*01 > 3'_IGHJ2*01 | 1344 | gnl\|Fabrus\|O12_IGKJ1*01 | 1101 |
| 1665 VH3-23_IGHD5-5*01 (2) > 1'_IGHJ2*01 | 1345 | gnl\|Fabrus\|O12_IGKJ1*01 | 1101 |
| 1666 VH3-23_IGHD5-5*01 (2) > 3'_IGHJ2*01 | 1346 | gnl\|Fabrus\|O12_IGKJ1*01 | 1101 |
| 1667 VH3-23_IGHD5-12*01 > 1'_IGHJ2*01 | 1347 | gnl\|Fabrus\|O12_IGKJ1*01 | 1101 |
| 1668 VH3-23_IGHD5-12*01 > 3'_IGHJ2*01 | 1348 | gnl\|Fabrus\|O12_IGKJ1*01 | 1101 |
| 1669 VH3-23_IGHD5-18*01 (2) > 1'_IGHJ2*01 | 1349 | gnl\|Fabrus\|O12_IGKJ1*01 | 1101 |
| 1670 VH3-23_IGHD5-18*01 (2) > 3'_IGHJ2*01 | 1350 | gnl\|Fabrus\|O12_IGKJ1*01 | 1101 |
| 1671 VH3-23_IGHD5-24*01 > 1'_IGHJ2*01 | 1351 | gnl\|Fabrus\|O12_IGKJ1*01 | 1101 |
| 1672 VH3-23_IGHD5-24*01 > 3'_IGHJ2*01 | 1352 | gnl\|Fabrus\|O12_IGKJ1*01 | 1101 |
| 1673 VH3-23_IGHD6-6*01 > 1'_IGHJ2*01 | 1353 | gnl\|Fabrus\|O12_IGKJ1*01 | 1101 |
| 1674 VH3-23_IGHD6-6*01 > 2'_IGHJ2*01 | 1354 | gnl\|Fabrus\|O12_IGKJ1*01 | 1101 |
| 1675 VH3-23_IGHD6-6*01 > 3'_IGHJ2*01 | 1355 | gnl\|Fabrus\|O12_IGKJ1*01 | 1101 |
| 1676 VH3-23_IGHD6-6*01 > 2_IGHJ2*01 | 1299 | gnl\|Fabrus\|O12_IGKJ1*01 | 1101 |
| 1677 VH3-23_IGHD6-13*01 > 1_IGHJ2*01 | 1300 | gnl\|Fabrus\|O12_IGKJ1*01 | 1101 |
| 1678 VH3-23_IGHD6-13*01 > 2_IGHJ2*01 | 1301 | gnl\|Fabrus\|O12_IGKJ1*01 | 1101 |
| 1679 VH3-23_IGHD6-19*01 > 1_IGHJ2*01 | 1302 | gnl\|Fabrus\|O12_IGKJ1*01 | 1101 |
| 1680 VH3-23_IGHD6-19*01 > 2_IGHJ2*01 | 1303 | gnl\|Fabrus\|O12_IGKJ1*01 | 1101 |
| 1681 VH3-23_IGHD6-25*01 > 1_IGHJ2*01 | 1304 | gnl\|Fabrus\|O12_IGKJ1*01 | 1101 |
| 1682 VH3-23_IGHD6-25*01 > 2_IGHJ2*01 | 1305 | gnl\|Fabrus\|O12_IGKJ1*01 | 1101 |
| 1683 VH3-23_IGHD7-27*01 > 1_IGHJ2*01 | 1306 | gnl\|Fabrus\|O12_IGKJ1*01 | 1101 |
| 1684 VH3-23_IGHD7-27*01 > 3_IGHJ2*01 | 1307 | gnl\|Fabrus\|O12_IGKJ1*01 | 1101 |
| 1685 VH3-23_IGHD6-13*01 > 1'_IGHJ2*01 | 1356 | gnl\|Fabrus\|O12_IGKJ1*01 | 1101 |
| 1686 VH3-23_IGHD6-13*01 > 2'_IGHJ2*01 | 1357 | gnl\|Fabrus\|O12_IGKJ1*01 | 1101 |
| 1687 VH3-23_IGHD6-13*01 > 2_IGHJ2*01_B | 1358 | gnl\|Fabrus\|O12_IGKJ1*01 | 1101 |
| 1688 VH3-23_IGHD6-19*01 > 1'_IGHJ2*01 | 1359 | gnl\|Fabrus\|O12_IGKJ1*01 | 1101 |
| 1689 VH3-23_IGHD6-19*01 > 2'_IGHJ2*01 | 1360 | gnl\|Fabrus\|O12_IGKJ1*01 | 1101 |
| 1690 VH3-23_IGHD6-19*01 > 2_IGHJ2*01_B | 1361 | gnl\|Fabrus\|O12_IGKJ1*01 | 1101 |
| 1691 VH3-23_IGHD6-25*01 > 1'_IGHJ2*01 | 1362 | gnl\|Fabrus\|O12_IGKJ1*01 | 1101 |
| 1692 VH3-23_IGHD6-25*01 > 3'_IGHJ2*01 | 1363 | gnl\|Fabrus\|O12_IGKJ1*01 | 1101 |
| 1693 VH3-23_IGHD7-27*01 > 1'_IGHJ2*01 | 1364 | gnl\|Fabrus\|O12_IGKJ1*01 | 1101 |
| 1694 VH3-23_IGHD7-27*01 > 2'_IGHJ2*01 | 1365 | gnl\|Fabrus\|O12_IGKJ1*01 | 1101 |
| 1695 VH3-23_IGHD1-1*01 > 1_IGHJ3*01 | 1366 | gnl\|Fabrus\|O12_IGKJ1*01 | 1101 |
| 1696 VH3-23_IGHD1-1*01 > 2_IGHJ3*01 | 1367 | gnl\|Fabrus\|O12_IGKJ1*01 | 1101 |
| 1697 VH3-23_IGHD1-1*01 > 3_IGHJ3*01 | 1368 | gnl\|Fabrus\|O12_IGKJ1*01 | 1101 |
| 1698 VH3-23_IGHD1-7*01 > 1_IGHJ3*01 | 1369 | gnl\|Fabrus\|O12_IGKJ1*01 | 1101 |
| 1699 VH3-23_IGHD1-7*01 > 3_IGHJ3*01 | 1370 | gnl\|Fabrus\|O12_IGKJ1*01 | 1101 |
| 1700 VH3-23_IGHD1-14*01 > 1_IGHJ3*01 | 1371 | gnl\|Fabrus\|O12_IGKJ1*01 | 1101 |
| 1701 VH3-23_IGHD1-14*01 > 3_IGHJ3*01 | 1372 | gnl\|Fabrus\|O12_IGKJ1*01 | 1101 |
| 1702 VH3-23_IGHD1-20*01 > 1_IGHJ3*01 | 1373 | gnl\|Fabrus\|O12_IGKJ1*01 | 1101 |
| 1703 VH3-23_IGHD1-20*01 > 3_IGHJ3*01 | 1374 | gnl\|Fabrus\|O12_IGKJ1*01 | 1101 |
| 1704 VH3-23_IGHD1-26*01 > 1_IGHJ3*01 | 1375 | gnl\|Fabrus\|O12_IGKJ1*01 | 1101 |
| 1705 VH3-23_IGHD1-26*01 > 3_IGHJ3*01 | 1376 | gnl\|Fabrus\|O12_IGKJ1*01 | 1101 |
| 1706 VH3-23_IGHD2-2*01 > 2_IGHJ3*01 | 1377 | gnl\|Fabrus\|O12_IGKJ1*01 | 1101 |
| 1707 VH3-23_IGHD2-2*01 > 3_IGHJ3*01 | 1378 | gnl\|Fabrus\|O12_IGKJ1*01 | 1101 |
| 1708 VH3-23_IGHD2-8*01 > 2_IGHJ3*01 | 1379 | gnl\|Fabrus\|O12_IGKJ1*01 | 1101 |
| 1709 VH3-23_IGHD2-8*01 > 3_IGHJ3*01 | 1380 | gnl\|Fabrus\|O12_IGKJ1*01 | 1101 |
| 1710 VH3-23_IGHD2-15*01 > 2_IGHJ3*01 | 1381 | gnl\|Fabrus\|O12_IGKJ1*01 | 1101 |
| 1711 VH3-23_IGHD2-15*01 > 3_IGHJ3*01 | 1382 | gnl\|Fabrus\|O12_IGKJ1*01 | 1101 |
| 1712 VH3-23_IGHD2-21*01 > 2_IGHJ3*01 | 1383 | gnl\|Fabrus\|O12_IGKJ1*01 | 1101 |
| 1713 VH3-23_IGHD2-21*01 > 3_IGHJ3*01 | 1384 | gnl\|Fabrus\|O12_IGKJ1*01 | 1101 |
| 1714 VH3-23_IGHD3-3*01 > 1_IGHJ3*01 | 1385 | gnl\|Fabrus\|O12_IGKJ1*01 | 1101 |
| 1715 VH3-23_IGHD3-3*01 > 2_IGHJ3*01 | 1386 | gnl\|Fabrus\|O12_IGKJ1*01 | 1101 |
| 1716 VH3-23_IGHD3-3*01 > 3_IGHJ3*01 | 1387 | gnl\|Fabrus\|O12_IGKJ1*01 | 1101 |
| 1717 VH3-23_IGHD3-9*01 > 2_IGHJ3*01 | 1388 | gnl\|Fabrus\|O12_IGKJ1*01 | 1101 |
| 1718 VH3-23_IGHD3-10*01 > 2_IGHJ3*01 | 1389 | gnl\|Fabrus\|O12_IGKJ1*01 | 1101 |
| 1719 VH3-23_IGHD3-10*01 > 3_IGHJ3*01 | 1390 | gnl\|Fabrus\|O12_IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1720 | VH3-23_IGHD3-16*01 > 2_IGHJ3*01 | 1391 | gnl|Fabrus|O12_IGKJ1*01 | 1101 |
| 1721 | VH3-23_IGHD3-16*01 > 3_IGHJ3*01 | 1392 | gnl|Fabrus|O12_IGKJ1*01 | 1101 |
| 1722 | VH3-23_IGHD3-22*01 > 2_IGHJ3*01 | 1393 | gnl|Fabrus|O12_IGKJ1*01 | 1101 |
| 1723 | VH3-23_IGHD3-22*01 > 3_IGHJ3*01 | 1394 | gnl|Fabrus|O12_IGKJ1*01 | 1101 |
| 1724 | VH3-23_IGHD4-4*01 (1) > 2_IGHJ3*01 | 1395 | gnl|Fabrus|O12_IGKJ1*01 | 1101 |
| 1725 | VH3-23_IGHD4-4*01 (1) > 3_IGHJ3*01 | 1396 | gnl|Fabrus|O12_IGKJ1*01 | 1101 |
| 1726 | VH3-23_IGHD4-11*01 (1) > 2_IGHJ3*01 | 1397 | gnl|Fabrus|O12_IGKJ1*01 | 1101 |
| 1727 | VH3-23_IGHD4-11*01 (1) > 3_IGHJ3*01 | 1398 | gnl|Fabrus|O12_IGKJ1*01 | 1101 |
| 1728 | VH3-23_IGHD4-17*01 > 2_IGHJ3*01 | 1399 | gnl|Fabrus|O12_IGKJ1*01 | 1101 |
| 1729 | VH3-23_IGHD4-17*01 > 3_IGHJ3*01 | 1400 | gnl|Fabrus|O12_IGKJ1*01 | 1101 |
| 1730 | VH3-23_IGHD4-23*01 > 2_IGHJ3*01 | 1401 | gnl|Fabrus|O12_IGKJ1*01 | 1101 |
| 1731 | VH3-23_IGHD4-23*01 > 3_IGHJ3*01 | 1402 | gnl|Fabrus|O12_IGKJ1*01 | 1101 |
| 1732 | VH3-23_IGHD5-5*01 (2) > 1_IGHJ3*01 | 1403 | gnl|Fabrus|O12_IGKJ1*01 | 1101 |
| 1733 | VH3-23_IGHD5-5*01 (2) > 2_IGHJ3*01 | 1404 | gnl|Fabrus|O12_IGKJ1*01 | 1101 |
| 1734 | VH3-23_IGHD5-5*01 (2) > 3_IGHJ3*01 | 1405 | gnl|Fabrus|O12_IGKJ1*01 | 1101 |
| 1735 | VH3-23_IGHD5-12*01 > 1_IGHJ3*01 | 1406 | gnl|Fabrus|O12_IGKJ1*01 | 1101 |
| 1736 | VH3-23_IGHD5-12*01 > 3_IGHJ3*01 | 1407 | gnl|Fabrus|O12_IGKJ1*01 | 1101 |
| 1737 | VH3-23_IGHD5-18*01 (2) > 1_IGHJ3*01 | 1408 | gnl|Fabrus|O12_IGKJ1*01 | 1101 |
| 1738 | VH3-23_IGHD5-18*01 (2) > 2_IGHJ3*01 | 1409 | gnl|Fabrus|O12_IGKJ1*01 | 1101 |
| 1739 | VH3-23_IGHD5-18*01 (2) > 3_IGHJ3*01 | 1410 | gnl|Fabrus|O12_IGKJ1*01 | 1101 |
| 1740 | VH3-23_IGHD5-24*01 > 1_IGHJ3*01 | 1411 | gnl|Fabrus|O12_IGKJ1*01 | 1101 |
| 1741 | VH3-23_IGHD5-24*01 > 3_IGHJ3*01 | 1412 | gnl|Fabrus|O12_IGKJ1*01 | 1101 |
| 1742 | VH3-23_IGHD6-6*01 > 1_IGHJ3*01 | 1413 | gnl|Fabrus|O12_IGKJ1*01 | 1101 |
| 1743 | VH3-23_IGHD1-1*01 > 1'_IGHJ3*01 | 1423 | gnl|Fabrus|O12_IGKJ1*01 | 1101 |
| 1744 | VH3-23_IGHD1-1*01 > 2'_IGHJ3*01 | 1424 | gnl|Fabrus|O12_IGKJ1*01 | 1101 |
| 1745 | VH3-23_IGHD1-1*01 > 3'_IGHJ3*01 | 1425 | gnl|Fabrus|O12_IGKJ1*01 | 1101 |
| 1746 | VH3-23_IGHD1-7*01 > 1'_IGHJ3*01 | 1426 | gnl|Fabrus|O12_IGKJ1*01 | 1101 |
| 1747 | VH3-23_IGHD1-7*01 > 3'_IGHJ3*01 | 1427 | gnl|Fabrus|O12_IGKJ1*01 | 1101 |
| 1748 | VH3-23_IGHD1-14*01 > 1'_IGHJ3*01 | 1428 | gnl|Fabrus|O12_IGKJ1*01 | 1101 |
| 1749 | VH3-23_IGHD1-14*01 > 2'_IGHJ3*01 | 1429 | gnl|Fabrus|O12_IGKJ1*01 | 1101 |
| 1750 | VH3-23_IGHD1-14*01 > 3'_IGHJ3*01 | 1430 | gnl|Fabrus|O12_IGKJ1*01 | 1101 |
| 1751 | VH3-23_IGHD1-20*01 > 1'_IGHJ3*01 | 1431 | gnl|Fabrus|O12_IGKJ1*01 | 1101 |
| 1752 | VH3-23_IGHD1-20*01 > 2'_IGHJ3*01 | 1432 | gnl|Fabrus|O12_IGKJ1*01 | 1101 |
| 1753 | VH3-23_IGHD1-20*01 > 3'_IGHJ3*01 | 1433 | gnl|Fabrus|O12_IGKJ1*01 | 1101 |
| 1754 | VH3-23_IGHD1-26*01 > 1'_IGHJ3*01 | 1434 | gnl|Fabrus|O12_IGKJ1*01 | 1101 |
| 1755 | VH3-23_IGHD1-26*01 > 3'_IGHJ3*01 | 1435 | gnl|Fabrus|O12_IGKJ1*01 | 1101 |
| 1756 | VH3-23_IGHD2-2*01 > 1'_IGHJ3*01 | 1436 | gnl|Fabrus|O12_IGKJ1*01 | 1101 |
| 1757 | VH3-23_IGHD2-2*01 > 3'_IGHJ3*01 | 1437 | gnl|Fabrus|O12_IGKJ1*01 | 1101 |
| 1758 | VH3-23_IGHD2-8*01 > 1'_IGHJ3*01 | 1438 | gnl|Fabrus|O12_IGKJ1*01 | 1101 |
| 1759 | VH3-23_IGHD2-15*01 > 1'_IGHJ3*01 | 1439 | gnl|Fabrus|O12_IGKJ1*01 | 1101 |
| 1760 | VH3-23_IGHD2-15*01 > 3'_IGHJ3*01 | 1440 | gnl|Fabrus|O12_IGKJ1*01 | 1101 |
| 1761 | VH3-23_IGHD2-21*01 > 1'_IGHJ3*01 | 1441 | gnl|Fabrus|O12_IGKJ1*01 | 1101 |
| 1762 | VH3-23_IGHD2-21*01 > 3'_IGHJ3*01 | 1442 | gnl|Fabrus|O12_IGKJ1*01 | 1101 |
| 1763 | VH3-23_IGHD3-3*01 > 1'_IGHJ3*01 | 1443 | gnl|Fabrus|O12_IGKJ1*01 | 1101 |
| 1764 | VH3-23_IGHD3-3*01 > 3'_IGHJ3*01 | 1444 | gnl|Fabrus|O12_IGKJ1*01 | 1101 |
| 1765 | VH3-23_IGHD3-9*01 > 1'_IGHJ3*01 | 1445 | gnl|Fabrus|O12_IGKJ1*01 | 1101 |
| 1766 | VH3-23_IGHD3-9*01 > 3'_IGHJ3*01 | 1446 | gnl|Fabrus|O12_IGKJ1*01 | 1101 |
| 1767 | VH3-23_IGHD3-10*01 > 1'_IGHJ3*01 | 1447 | gnl|Fabrus|O12_IGKJ1*01 | 1101 |
| 1768 | VH3-23_IGHD3-10*01 > 3'_IGHJ3*01 | 1448 | gnl|Fabrus|O12_IGKJ1*01 | 1101 |
| 1769 | VH3-23_IGHD3-16*01 > 1'_IGHJ3*01 | 1449 | gnl|Fabrus|O12_IGKJ1*01 | 1101 |
| 1770 | VH3-23_IGHD3-16*01 > 3'_IGHJ3*01 | 1450 | gnl|Fabrus|O12_IGKJ1*01 | 1101 |
| 1771 | VH3-23_IGHD3-22*01 > 1'_IGHJ3*01 | 1451 | gnl|Fabrus|O12_IGKJ1*01 | 1101 |
| 1772 | VH3-23_IGHD4-4*01 (1) > 1'_IGHJ3*01 | 1452 | gnl|Fabrus|O12_IGKJ1*01 | 1101 |
| 1773 | VH3-23_IGHD4-4*01 (1) > 3'_IGHJ3*01 | 1453 | gnl|Fabrus|O12_IGKJ1*01 | 1101 |
| 1774 | VH3-23_IGHD4-11*01 (1) > 1'_IGHJ3*01 | 1454 | gnl|Fabrus|O12_IGKJ1*01 | 1101 |
| 1775 | VH3-23_IGHD4-11*01 (1) > 3'_IGHJ3*01 | 1455 | gnl|Fabrus|O12_IGKJ1*01 | 1101 |
| 1776 | VH3-23_IGHD4-17*01 > 1'_IGHJ3*01 | 1456 | gnl|Fabrus|O12_IGKJ1*01 | 1101 |
| 1777 | VH3-23_IGHD4-17*01 > 3'_IGHJ3*01 | 1457 | gnl|Fabrus|O12_IGKJ1*01 | 1101 |
| 1778 | VH3-23_IGHD4-23*01 > 1'_IGHJ3*01 | 1458 | gnl|Fabrus|O12_IGKJ1*01 | 1101 |
| 1779 | VH3-23_IGHD4-23*01 > 3'_IGHJ3*01 | 1459 | gnl|Fabrus|O12_IGKJ1*01 | 1101 |
| 1780 | VH3-23_IGHD5-5*01 (2) > 1'_IGHJ3*01 | 1460 | gnl|Fabrus|O12_IGKJ1*01 | 1101 |
| 1781 | VH3-23_IGHD5-5*01 (2) > 3'_IGHJ3*01 | 1461 | gnl|Fabrus|O12_IGKJ1*01 | 1101 |
| 1782 | VH3-23_IGHD5-12*01 > 1'_IGHJ3*01 | 1462 | gnl|Fabrus|O12_IGKJ1*01 | 1101 |
| 1783 | VH3-23_IGHD5-12*01 > 3'_IGHJ3*01 | 1463 | gnl|Fabrus|O12_IGKJ1*01 | 1101 |
| 1784 | VH3-23_IGHD5-18*01 (2) > 1'_IGHJ3*01 | 1464 | gnl|Fabrus|O12_IGKJ1*01 | 1101 |
| 1785 | VH3-23_IGHD5-18*01 (2) > 3'_IGHJ3*01 | 1465 | gnl|Fabrus|O12_IGKJ1*01 | 1101 |
| 1786 | VH3-23_IGHD5-24*01 > 1'_IGHJ3*01 | 1466 | gnl|Fabrus|O12_IGKJ1*01 | 1101 |
| 1787 | VH3-23_IGHD5-24*01 > 3'_IGHJ3*01 | 1467 | gnl|Fabrus|O12_IGKJ1*01 | 1101 |
| 1788 | VH3-23_IGHD6-6*01 > 1'_IGHJ3*01 | 1468 | gnl|Fabrus|O12_IGKJ1*01 | 1101 |
| 1789 | VH3-23_IGHD6-6*01 > 2'_IGHJ3*01 | 1469 | gnl|Fabrus|O12_IGKJ1*01 | 1101 |
| 1790 | VH3-23_IGHD6-6*01 > 3'_IGHJ3*01 | 1470 | gnl|Fabrus|O12_IGKJ1*01 | 1101 |
| 1791 | VH3-23_IGHD6-6*01 > 2_IGHJ3*01 | 1414 | gnl|Fabrus|O12_IGKJ1*01 | 1101 |
| 1792 | VH3-23_IGHD6-13*01 > 1_IGHJ3*01 | 1415 | gnl|Fabrus|O12_IGKJ1*01 | 1101 |
| 1793 | VH3-23_IGHD6-13*01 > 2_IGHJ3*01 | 1416 | gnl|Fabrus|O12_IGKJ1*01 | 1101 |

TABLE 4-continued

Exemplary Paired Nucleic Acid Library

| HEAVY CHAIN | SEQ ID NO | LIGHT CHAIN | SEQ ID NO |
|---|---|---|---|
| 1794 VH3-23_IGHD6-19*01 > 1__IGHJ3*01 | 1417 | gnl\|Fabrus\|O12_IGKJ1*01 | 1101 |
| 1795 VH3-23_IGHD6-19*01 > 2__IGHJ3*01 | 1418 | gnl\|Fabrus\|O12_IGKJ1*01 | 1101 |
| 1796 VH3-23_IGHD6-25*01 > 1__IGHJ3*01 | 1419 | gnl\|Fabrus\|O12_IGKJ1*01 | 1101 |
| 1797 VH3-23_IGHD6-25*01 > 2__IGHJ3*01 | 1420 | gnl\|Fabrus\|O12_IGKJ1*01 | 1101 |
| 1798 VH3-23_IGHD7-27*01 > 1__IGHJ3*01 | 1421 | gnl\|Fabrus\|O12_IGKJ1*01 | 1101 |
| 1799 VH3-23_IGHD7-27*01 > 3__IGHJ3*01 | 1422 | gnl\|Fabrus\|O12_IGKJ1*01 | 1101 |
| 1800 VH3-23_IGHD6-13*01 > 1'__IGHJ3*01 | 1471 | gnl\|Fabrus\|O12_IGKJ1*01 | 1101 |
| 1801 VH3-23_IGHD6-13*01 > 2'__IGHJ3*01 | 1472 | gnl\|Fabrus\|O12_IGKJ1*01 | 1101 |
| 1802 VH3-23_IGHD6-13*01 > 1__IGHJ6*01 | 1473 | gnl\|Fabrus\|O12_IGKJ1*01 | 1101 |
| 1803 VH3-23_IGHD6-19*01 > 1'__IGHJ3*01 | 1474 | gnl\|Fabrus\|O12_IGKJ1*01 | 1101 |
| 1804 VH3-23_IGHD6-19*01 > 2'__IGHJ3*01 | 1475 | gnl\|Fabrus\|O12_IGKJ1*01 | 1101 |
| 1805 VH3-23_IGHD6-19*01 > 3'__IGHJ3*01 | 1476 | gnl\|Fabrus\|O12_IGKJ1*01 | 1101 |
| 1806 VH3-23_IGHD6-25*01 > 1'__IGHJ3*01 | 1477 | gnl\|Fabrus\|O12_IGKJ1*01 | 1101 |
| 1807 VH3-23_IGHD6-25*01 > 3'__IGHJ3*01 | 1478 | gnl\|Fabrus\|O12_IGKJ1*01 | 1101 |
| 1808 VH3-23_IGHD7-27*01 > 1'__IGHJ3*01 | 1479 | gnl\|Fabrus\|O12_IGKJ1*01 | 1101 |
| 1809 VH3-23_IGHD7-27*01 > 2'__IGHJ3*01 | 1480 | gnl\|Fabrus\|O12_IGKJ1*01 | 1101 |
| 1810 VH3-23_IGHD1-1*01 > 1__IGHJ4*01 | 1481 | gnl\|Fabrus\|O12_IGKJ1*01 | 1101 |
| 1811 VH3-23_IGHD1-1*01 > 2__IGHJ4*01 | 1482 | gnl\|Fabrus\|O12_IGKJ1*01 | 1101 |
| 1812 VH3-23_IGHD1-1*01 > 3__IGHJ4*01 | 1483 | gnl\|Fabrus\|O12_IGKJ1*01 | 1101 |
| 1813 VH3-23_IGHD1-7*01 > 1__IGHJ4*01 | 1484 | gnl\|Fabrus\|O12_IGKJ1*01 | 1101 |
| 1814 VH3-23_IGHD1-7*01 > 3__IGHJ4*01 | 1485 | gnl\|Fabrus\|O12_IGKJ1*01 | 1101 |
| 1815 VH3-23_IGHD1-14*01 > 1__IGHJ4*01 | 1486 | gnl\|Fabrus\|O12_IGKJ1*01 | 1101 |
| 1816 VH3-23_IGHD1-14*01 > 3__IGHJ4*01 | 1487 | gnl\|Fabrus\|O12_IGKJ1*01 | 1101 |
| 1817 VH3-23_IGHD1-20*01 > 1__IGHJ4*01 | 1488 | gnl\|Fabrus\|O12_IGKJ1*01 | 1101 |
| 1818 VH3-23_IGHD1-20*01 > 3__IGHJ4*01 | 1489 | gnl\|Fabrus\|O12_IGKJ1*01 | 1101 |
| 1819 VH3-23_IGHD1-26*01 > 1__IGHJ4*01 | 1490 | gnl\|Fabrus\|O12_IGKJ1*01 | 1101 |
| 1820 VH3-23_IGHD1-26*01 > 3__IGHJ4*01 | 1491 | gnl\|Fabrus\|O12_IGKJ1*01 | 1101 |
| 1821 VH3-23_IGHD2-2*01 > 2__IGHJ4*01 | 1492 | gnl\|Fabrus\|O12_IGKJ1*01 | 1101 |
| 1822 VH3-23_IGHD2-2*01 > 3__IGHJ4*01 | 1493 | gnl\|Fabrus\|O12_IGKJ1*01 | 1101 |
| 1823 VH3-23_IGHD2-8*01 > 2__IGHJ4*01 | 1494 | gnl\|Fabrus\|O12_IGKJ1*01 | 1101 |
| 1824 VH3-23_IGHD2-8*01 > 3__IGHJ4*01 | 1495 | gnl\|Fabrus\|O12_IGKJ1*01 | 1101 |
| 1825 VH3-23_IGHD2-15*01 > 2__IGHJ4*01 | 1496 | gnl\|Fabrus\|O12_IGKJ1*01 | 1101 |
| 1826 VH3-23_IGHD2-15*01 > 3__IGHJ4*01 | 1497 | gnl\|Fabrus\|O12_IGKJ1*01 | 1101 |
| 1827 VH3-23_IGHD2-21*01 > 2__IGHJ4*01 | 1498 | gnl\|Fabrus\|O12_IGKJ1*01 | 1101 |
| 1828 VH3-23_IGHD2-21*01 > 3__IGHJ4*01 | 1499 | gnl\|Fabrus\|O12_IGKJ1*01 | 1101 |
| 1829 VH3-23_IGHD3-3*01 > 1__IGHJ4*01 | 1500 | gnl\|Fabrus\|O12_IGKJ1*01 | 1101 |
| 1830 VH3-23_IGHD3-3*01 > 2__IGHJ4*01 | 1501 | gnl\|Fabrus\|O12_IGKJ1*01 | 1101 |
| 1831 VH3-23_IGHD3-3*01 > 3__IGHJ4*01 | 1502 | gnl\|Fabrus\|O12_IGKJ1*01 | 1101 |
| 1832 VH3-23_IGHD3-9*01 > 2__IGHJ4*01 | 1503 | gnl\|Fabrus\|O12_IGKJ1*01 | 1101 |
| 1833 VH3-23_IGHD3-10*01 > 2__IGHJ4*01 | 1504 | gnl\|Fabrus\|O12_IGKJ1*01 | 1101 |
| 1834 VH3-23_IGHD3-10*01 > 3__IGHJ4*01 | 1505 | gnl\|Fabrus\|O12_IGKJ1*01 | 1101 |
| 1835 VH3-23_IGHD3-16*01 > 2__IGHJ4*01 | 1506 | gnl\|Fabrus\|O12_IGKJ1*01 | 1101 |
| 1836 VH3-23_IGHD3-16*01 > 3__IGHJ4*01 | 1507 | gnl\|Fabrus\|O12_IGKJ1*01 | 1101 |
| 1837 VH3-23_IGHD3-22*01 > 2__IGHJ4*01 | 1508 | gnl\|Fabrus\|O12_IGKJ1*01 | 1101 |
| 1838 VH3-23_IGHD3-22*01 > 3__IGHJ4*01 | 1509 | gnl\|Fabrus\|O12_IGKJ1*01 | 1101 |
| 1839 VH3-23_IGHD4-4*01 (1) > 2__IGHJ4*01 | 1510 | gnl\|Fabrus\|O12_IGKJ1*01 | 1101 |
| 1840 VH3-23_IGHD4-4*01 (1) > 3__IGHJ4*01 | 1511 | gnl\|Fabrus\|O12_IGKJ1*01 | 1101 |
| 1841 VH3-23_IGHD4-11*01 (1) > 2__IGHJ4*01 | 1512 | gnl\|Fabrus\|O12_IGKJ1*01 | 1101 |
| 1842 VH3-23_IGHD4-11*01 (1) > 3__IGHJ4*01 | 1513 | gnl\|Fabrus\|O12_IGKJ1*01 | 1101 |
| 1843 VH3-23_IGHD4-17*01 > 2__IGHJ4*01 | 1514 | gnl\|Fabrus\|O12_IGKJ1*01 | 1101 |
| 1844 VH3-23_IGHD4-17*01 > 3__IGHJ4*01 | 1515 | gnl\|Fabrus\|O12_IGKJ1*01 | 1101 |
| 1845 VH3-23_IGHD4-23*01 > 2__IGHJ4*01 | 1516 | gnl\|Fabrus\|O12_IGKJ1*01 | 1101 |
| 1846 VH3-23_IGHD4-23*01 > 3__IGHJ4*01 | 1517 | gnl\|Fabrus\|O12_IGKJ1*01 | 1101 |
| 1847 VH3-23_IGHD5-5*01 (2) > 1__IGHJ4*01 | 1518 | gnl\|Fabrus\|O12_IGKJ1*01 | 1101 |
| 1848 VH3-23_IGHD5-5*01 (2) > 2__IGHJ4*01 | 1519 | gnl\|Fabrus\|O12_IGKJ1*01 | 1101 |
| 1849 VH3-23_IGHD5-5*01 (2) > 3__IGHJ4*01 | 1520 | gnl\|Fabrus\|O12_IGKJ1*01 | 1101 |
| 1850 VH3-23_IGHD5-12*01 > 1__IGHJ4*01 | 1521 | gnl\|Fabrus\|O12_IGKJ1*01 | 1101 |
| 1851 VH3-23_IGHD5-12*01 > 3__IGHJ4*01 | 1522 | gnl\|Fabrus\|O12_IGKJ1*01 | 1101 |
| 1852 VH3-23_IGHD5-18*01 (2) > 1__IGHJ4*01 | 1523 | gnl\|Fabrus\|O12_IGKJ1*01 | 1101 |
| 1853 VH3-23_IGHD5-18*01 (2) > 2__IGHJ4*01 | 1524 | gnl\|Fabrus\|O12_IGKJ1*01 | 1101 |
| 1854 VH3-23_IGHD5-18*01 (2) > 3__IGHJ4*01 | 1525 | gnl\|Fabrus\|O12_IGKJ1*01 | 1101 |
| 1855 VH3-23_IGHD5-24*01 > 1__IGHJ4*01 | 1526 | gnl\|Fabrus\|O12_IGKJ1*01 | 1101 |
| 1856 VH3-23_IGHD5-24*01 > 3__IGHJ4*01 | 1527 | gnl\|Fabrus\|O12_IGKJ1*01 | 1101 |
| 1857 VH3-23_IGHD6-6*01 > 1__IGHJ4*01 | 1528 | gnl\|Fabrus\|O12_IGKJ1*01 | 1101 |
| 1858 VH3-23_IGHD1-1*01 > 1'__IGHJ4*01 | 1538 | gnl\|Fabrus\|O12_IGKJ1*01 | 1101 |
| 1859 VH3-23_IGHD1-1*01 > 2'__IGHJ4*01 | 1539 | gnl\|Fabrus\|O12_IGKJ1*01 | 1101 |
| 1860 VH3-23_IGHD1-1*01 > 3'__IGHJ4*01 | 1540 | gnl\|Fabrus\|O12_IGKJ1*01 | 1101 |
| 1861 VH3-23_IGHD1-7*01 > 1'__IGHJ4*01 | 1541 | gnl\|Fabrus\|O12_IGKJ1*01 | 1101 |
| 1862 VH3-23_IGHD1-7*01 > 3'__IGHJ4*01 | 1542 | gnl\|Fabrus\|O12_IGKJ1*01 | 1101 |
| 1863 VH3-23_IGHD1-14*01 > 1'__IGHJ4*01 | 1543 | gnl\|Fabrus\|O12_IGKJ1*01 | 1101 |
| 1864 VH3-23_IGHD1-14*01 > 2'__IGHJ4*01 | 1544 | gnl\|Fabrus\|O12_IGKJ1*01 | 1101 |
| 1865 VH3-23_IGHD1-14*01 > 3'__IGHJ4*01 | 1545 | gnl\|Fabrus\|O12_IGKJ1*01 | 1101 |
| 1866 VH3-23_IGHD1-20*01 > 1'__IGHJ4*01 | 1546 | gnl\|Fabrus\|O12_IGKJ1*01 | 1101 |
| 1867 VH3-23_IGHD1-20*01 > 2'__IGHJ4*01 | 1547 | gnl\|Fabrus\|O12_IGKJ1*01 | 1101 |

TABLE 4-continued

Exemplary Paired Nucleic Acid Library

| HEAVY CHAIN | SEQ ID NO | LIGHT CHAIN | SEQ ID NO |
|---|---|---|---|
| 1868 VH3-23_IGHD1-20*01 > 3'_IGHJ4*01 | 1548 | gnl|Fabrus|O12_IGKJ1*01 | 1101 |
| 1869 VH3-23_IGHD1-26*01 > 1'_IGHJ4*01 | 1549 | gnl|Fabrus|O12_IGKJ1*01 | 1101 |
| 1870 VH3-23_IGHD1-26*01 > 1_IGHJ4*01_B | 1550 | gnl|Fabrus|O12_IGKJ1*01 | 1101 |
| 1871 VH3-23_IGHD2-2*01 > 1'_IGHJ4*01 | 1551 | gnl|Fabrus|O12_IGKJ1*01 | 1101 |
| 1872 VH3-23_IGHD2-2*01 > 3'_IGHJ4*01 | 1552 | gnl|Fabrus|O12_IGKJ1*01 | 1101 |
| 1873 VH3-23_IGHD2-8*01 > 1'_IGHJ4*01 | 1553 | gnl|Fabrus|O12_IGKJ1*01 | 1101 |
| 1874 VH3-23_IGHD2-15*01 > 1'_IGHJ4*01 | 1554 | gnl|Fabrus|O12_IGKJ1*01 | 1101 |
| 1875 VH3-23_IGHD2-15*01 > 3'_IGHJ4*01 | 1555 | gnl|Fabrus|O12_IGKJ1*01 | 1101 |
| 1876 VH3-23_IGHD2-21*01 > 1'_IGHJ4*01 | 1556 | gnl|Fabrus|O12_IGKJ1*01 | 1101 |
| 1877 VH3-23_IGHD2-21*01 > 3'_IGHJ4*01 | 1557 | gnl|Fabrus|O12_IGKJ1*01 | 1101 |
| 1878 VH3-23_IGHD3-3*01 > 1'_IGHJ4*01 | 1558 | gnl|Fabrus|O12_IGKJ1*01 | 1101 |
| 1879 VH3-23_IGHD3-3*01 > 3'_IGHJ4*01 | 1559 | gnl|Fabrus|O12_IGKJ1*01 | 1101 |
| 1880 VH3-23_IGHD3-9*01 > 1'_IGHJ4*01 | 1560 | gnl|Fabrus|O12_IGKJ1*01 | 1101 |
| 1881 VH3-23_IGHD3-9*01 > 3'_IGHJ4*01 | 1561 | gnl|Fabrus|O12_IGKJ1*01 | 1101 |
| 1882 VH3-23_IGHD3-10*01 > 1'_IGHJ4*01 | 1562 | gnl|Fabrus|O12_IGKJ1*01 | 1101 |
| 1883 VH3-23_IGHD3-10*01 > 3'_IGHJ4*01 | 1563 | gnl|Fabrus|O12_IGKJ1*01 | 1101 |
| 1884 VH3-23_IGHD3-16*01 > 1'_IGHJ4*01 | 1564 | gnl|Fabrus|O12_IGKJ1*01 | 1101 |
| 1885 VH3-23_IGHD3-16*01 > 3'_IGHJ4*01 | 1565 | gnl|Fabrus|O12_IGKJ1*01 | 1101 |
| 1886 VH3-23_IGHD3-22*01 > 1'_IGHJ4*01 | 1566 | gnl|Fabrus|O12_IGKJ1*01 | 1101 |
| 1887 VH3-23_IGHD4-4*01 (1) > 1'_IGHJ4*01 | 1567 | gnl|Fabrus|O12_IGKJ1*01 | 1101 |
| 1888 VH3-23_IGHD4-4*01 (1) > 3'_IGHJ4*01 | 1568 | gnl|Fabrus|O12_IGKJ1*01 | 1101 |
| 1889 VH3-23_IGHD4-11*01 (1) > 1'_IGHJ4*01 | 1569 | gnl|Fabrus|O12_IGKJ1*01 | 1101 |
| 1890 VH3-23_IGHD4-11*01 (1) > 3'_IGHJ4*01 | 1570 | gnl|Fabrus|O12_IGKJ1*01 | 1101 |
| 1891 VH3-23_IGHD4-17*01 > 1'_IGHJ4*01 | 1571 | gnl|Fabrus|O12_IGKJ1*01 | 1101 |
| 1892 VH3-23_IGHD4-17*01 > 3'_IGHJ4*01 | 1572 | gnl|Fabrus|O12_IGKJ1*01 | 1101 |
| 1893 VH3-23_IGHD4-23*01 > 1'_IGHJ4*01 | 1573 | gnl|Fabrus|O12_IGKJ1*01 | 1101 |
| 1894 VH3-23_IGHD4-23*01 > 3'_IGHJ4*01 | 1574 | gnl|Fabrus|O12_IGKJ1*01 | 1101 |
| 1895 VH3-23_IGHD5-5*01 (2) > 1'_IGHJ4*01 | 1575 | gnl|Fabrus|O12_IGKJ1*01 | 1101 |
| 1896 VH3-23_IGHD5-5*01 (2) > 3'_IGHJ4*01 | 1576 | gnl|Fabrus|O12_IGKJ1*01 | 1101 |
| 1897 VH3-23_IGHD5-12*01 > 1'_IGHJ4*01 | 1577 | gnl|Fabrus|O12_IGKJ1*01 | 1101 |
| 1898 VH3-23_IGHD5-12*01 > 3'_IGHJ4*01 | 1578 | gnl|Fabrus|O12_IGKJ1*01 | 1101 |
| 1899 VH3-23_IGHD5-18*01 (2) > 1'_IGHJ4*01 | 1579 | gnl|Fabrus|O12_IGKJ1*01 | 1101 |
| 1900 VH3-23_IGHD5-18*01 (2) > 3'_IGHJ4*01 | 1580 | gnl|Fabrus|O12_IGKJ1*01 | 1101 |
| 1901 VH3-23_IGHD5-24*01 > 1'_IGHJ4*01 | 1581 | gnl|Fabrus|O12_IGKJ1*01 | 1101 |
| 1902 VH3-23_IGHD5-24*01 > 3'_IGHJ4*01 | 1582 | gnl|Fabrus|O12_IGKJ1*01 | 1101 |
| 1903 VH3-23_IGHD6-6*01 > 1'_IGHJ4*01 | 1583 | gnl|Fabrus|O12_IGKJ1*01 | 1101 |
| 1904 VH3-23_IGHD6-6*01 > 2'_IGHJ4*01 | 1584 | gnl|Fabrus|O12_IGKJ1*01 | 1101 |
| 1905 VH3-23_IGHD6-6*01 > 3'_IGHJ4*01 | 1585 | gnl|Fabrus|O12_IGKJ1*01 | 1101 |
| 1906 VH3-23_IGHD6-6*01 > 2_IGHJ4*01 | 1529 | gnl|Fabrus|O12_IGKJ1*01 | 1101 |
| 1907 VH3-23_IGHD6-13*01 > 1_IGHJ4*01 | 1530 | gnl|Fabrus|O12_IGKJ1*01 | 1101 |
| 1908 VH3-23_IGHD6-13*01 > 2_IGHJ4*01 | 1531 | gnl|Fabrus|O12_IGKJ1*01 | 1101 |
| 1909 VH3-23_IGHD6-19*01 > 1_IGHJ4*01 | 1532 | gnl|Fabrus|O12_IGKJ1*01 | 1101 |
| 1910 VH3-23_IGHD6-19*01 > 2_IGHJ4*01 | 1533 | gnl|Fabrus|O12_IGKJ1*01 | 1101 |
| 1911 VH3-23_IGHD6-25*01 > 1_IGHJ4*01 | 1534 | gnl|Fabrus|O12_IGKJ1*01 | 1101 |
| 1912 VH3-23_IGHD6-25*01 > 2_IGHJ4*01 | 1535 | gnl|Fabrus|O12_IGKJ1*01 | 1101 |
| 1913 VH3-23_IGHD7-27*01 > 1_IGHJ4*01 | 1536 | gnl|Fabrus|O12_IGKJ1*01 | 1101 |
| 1914 VH3-23_IGHD7-27*01 > 3_IGHJ4*01 | 1537 | gnl|Fabrus|O12_IGKJ1*01 | 1101 |
| 1915 VH3-23_IGHD6-13*01 > 1'_IGHJ4*01 | 1586 | gnl|Fabrus|O12_IGKJ1*01 | 1101 |
| 1916 VH3-23_IGHD6-13*01 > 2'_IGHJ4*01 | 1587 | gnl|Fabrus|O12_IGKJ1*01 | 1101 |
| 1917 VH3-23_IGHD6-13*01 > 2_IGHJ4*01_B | 1588 | gnl|Fabrus|O12_IGKJ1*01 | 1101 |
| 1918 VH3-23_IGHD6-19*01 > 1'_IGHJ4*01 | 1589 | gnl|Fabrus|O12_IGKJ1*01 | 1101 |
| 1919 VH3-23_IGHD6-19*01 > 2'_IGHJ4*01 | 1590 | gnl|Fabrus|O12_IGKJ1*01 | 1101 |
| 1920 VH3-23_IGHD6-19*01 > 2_IGHJ4*01_B | 1591 | gnl|Fabrus|O12_IGKJ1*01 | 1101 |
| 1921 VH3-23_IGHD6-25*01 > 1'_IGHJ4*01 | 1592 | gnl|Fabrus|O12_IGKJ1*01 | 1101 |
| 1922 VH3-23_IGHD6-25*01 > 3'_IGHJ4*01 | 1593 | gnl|Fabrus|O12_IGKJ1*01 | 1101 |
| 1923 VH3-23_IGHD7-27*01 > 1'_IGHJ4*01 | 1594 | gnl|Fabrus|O12_IGKJ1*01 | 1101 |
| 1924 VH3-23_IGHD7-27*01 > 2'_IGHJ4*01 | 1595 | gnl|Fabrus|O12_IGKJ1*01 | 1101 |
| 1925 VH3-23_IGHD1-1*01 > 1_IGHJ5*01 | 1596 | gnl|Fabrus|O12_IGKJ1*01 | 1101 |
| 1926 VH3-23_IGHD1-1*01 > 2_IGHJ5*01 | 1597 | gnl|Fabrus|O12_IGKJ1*01 | 1101 |
| 1927 VH3-23_IGHD1-1*01 > 3_IGHJ5*01 | 1598 | gnl|Fabrus|O12_IGKJ1*01 | 1101 |
| 1928 VH3-23_IGHD1-7*01 > 1_IGHJ5*01 | 1599 | gnl|Fabrus|O12_IGKJ1*01 | 1101 |
| 1929 VH3-23_IGHD1-7*01 > 3_IGHJ5*01 | 1600 | gnl|Fabrus|O12_IGKJ1*01 | 1101 |
| 1930 VH3-23_IGHD1-14*01 > 1_IGHJ5*01 | 1601 | gnl|Fabrus|O12_IGKJ1*01 | 1101 |
| 1931 VH3-23_IGHD1-14*01 > 3_IGHJ5*01 | 1602 | gnl|Fabrus|O12_IGKJ1*01 | 1101 |
| 1932 VH3-23_IGHD1-20*01 > 1_IGHJ5*01 | 1603 | gnl|Fabrus|O12_IGKJ1*01 | 1101 |
| 1933 VH3-23_IGHD1-20*01 > 3_IGHJ5*01 | 1604 | gnl|Fabrus|O12_IGKJ1*01 | 1101 |
| 1934 VH3-23_IGHD1-26*01 > 1_IGHJ5*01 | 1605 | gnl|Fabrus|O12_IGKJ1*01 | 1101 |
| 1935 VH3-23_IGHD1-26*01 > 3_IGHJ5*01 | 1606 | gnl|Fabrus|O12_IGKJ1*01 | 1101 |
| 1936 VH3-23_IGHD2-2*01 > 2_IGHJ5*01 | 1607 | gnl|Fabrus|O12_IGKJ1*01 | 1101 |
| 1937 VH3-23_IGHD2-2*01 > 3_IGHJ5*01 | 1608 | gnl|Fabrus|O12_IGKJ1*01 | 1101 |
| 1938 VH3-23_IGHD2-8*01 > 2_IGHJ5*01 | 1609 | gnl|Fabrus|O12_IGKJ1*01 | 1101 |
| 1939 VH3-23_IGHD2-8*01 > 3_IGHJ5*01 | 1610 | gnl|Fabrus|O12_IGKJ1*01 | 1101 |
| 1940 VH3-23_IGHD2-15*01 > 2_IGHJ5*01 | 1611 | gnl|Fabrus|O12_IGKJ1*01 | 1101 |
| 1941 VH3-23_IGHD2-15*01 > 3_IGHJ5*01 | 1612 | gnl|Fabrus|O12_IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 1942 | VH3-23_IGHD2-21*01 > 2_IGHJ5*01 | 1613 | gnl|Fabrus|O12_IGKJ1*01 | 1101 |
| 1943 | VH3-23_IGHD2-21*01 > 3_IGHJ5*01 | 1614 | gnl|Fabrus|O12_IGKJ1*01 | 1101 |
| 1944 | VH3-23_IGHD3-3*01 > 1_IGHJ5*01 | 1615 | gnl|Fabrus|O12_IGKJ1*01 | 1101 |
| 1945 | VH3-23_IGHD3-3*01 > 2_IGHJ5*01 | 1616 | gnl|Fabrus|O12_IGKJ1*01 | 1101 |
| 1946 | VH3-23_IGHD3-3*01 > 3_IGHJ5*01 | 1617 | gnl|Fabrus|O12_IGKJ1*01 | 1101 |
| 1947 | VH3-23_IGHD3-9*01 > 2_IGHJ5*01 | 1618 | gnl|Fabrus|O12_IGKJ1*01 | 1101 |
| 1948 | VH3-23_IGHD3-10*01 > 2_IGHJ5*01 | 1619 | gnl|Fabrus|O12_IGKJ1*01 | 1101 |
| 1949 | VH3-23_IGHD3-10*01 > 3_IGHJ5*01 | 1620 | gnl|Fabrus|O12_IGKJ1*01 | 1101 |
| 1950 | VH3-23_IGHD3-16*01 > 2_IGHJ5*01 | 1621 | gnl|Fabrus|O12_IGKJ1*01 | 1101 |
| 1951 | VH3-23_IGHD3-16*01 > 3_IGHJ5*01 | 1622 | gnl|Fabrus|O12_IGKJ1*01 | 1101 |
| 1952 | VH3-23_IGHD3-22*01 > 2_IGHJ5*01 | 1623 | gnl|Fabrus|O12_IGKJ1*01 | 1101 |
| 1953 | VH3-23_IGHD3-22*01 > 3_IGHJ5*01 | 1624 | gnl|Fabrus|O12_IGKJ1*01 | 1101 |
| 1954 | VH3-23_IGHD4-4*01 (1) > 2_IGHJ5*01 | 1625 | gnl|Fabrus|O12_IGKJ1*01 | 1101 |
| 1955 | VH3-23_IGHD4-4*01 (1) > 3_IGHJ5*01 | 1626 | gnl|Fabrus|O12_IGKJ1*01 | 1101 |
| 1956 | VH3-23_IGHD4-11*01 (1) > 2_IGHJ5*01 | 1627 | gnl|Fabrus|O12_IGKJ1*01 | 1101 |
| 1957 | VH3-23_IGHD4-11*01 (1) > 3_IGHJ5*01 | 1628 | gnl|Fabrus|O12_IGKJ1*01 | 1101 |
| 1958 | VH3-23_IGHD4-17*01 > 2_IGHJ5*01 | 1629 | gnl|Fabrus|O12_IGKJ1*01 | 1101 |
| 1959 | VH3-23_IGHD4-17*01 > 3_IGHJ5*01 | 1630 | gnl|Fabrus|O12_IGKJ1*01 | 1101 |
| 1960 | VH3-23_IGHD4-23*01 > 2_IGHJ5*01 | 1631 | gnl|Fabrus|O12_IGKJ1*01 | 1101 |
| 1961 | VH3-23_IGHD4-23*01 > 3_IGHJ5*01 | 1632 | gnl|Fabrus|O12_IGKJ1*01 | 1101 |
| 1962 | VH3-23_IGHD5-5*01 (2) > 1_IGHJ5*01 | 1633 | gnl|Fabrus|O12_IGKJ1*01 | 1101 |
| 1963 | VH3-23_IGHD5-5*01 (2) > 2_IGHJ5*01 | 1634 | gnl|Fabrus|O12_IGKJ1*01 | 1101 |
| 1964 | VH3-23_IGHD5-5*01 (2) > 3_IGHJ5*01 | 1635 | gnl|Fabrus|O12_IGKJ1*01 | 1101 |
| 1965 | VH3-23_IGHD5-12*01 > 1_IGHJ5*01 | 1636 | gnl|Fabrus|O12_IGKJ1*01 | 1101 |
| 1966 | VH3-23_IGHD5-12*01 > 3_IGHJ5*01 | 1637 | gnl|Fabrus|O12_IGKJ1*01 | 1101 |
| 1967 | VH3-23_IGHD5-18*01 (2) > 1_IGHJ5*01 | 1638 | gnl|Fabrus|O12_IGKJ1*01 | 1101 |
| 1968 | VH3-23_IGHD5-18*01 (2) > 2_IGHJ5*01 | 1639 | gnl|Fabrus|O12_IGKJ1*01 | 1101 |
| 1969 | VH3-23_IGHD5-18*01 (2) > 3_IGHJ5*01 | 1640 | gnl|Fabrus|O12_IGKJ1*01 | 1101 |
| 1970 | VH3-23_IGHD5-24*01 > 1_IGHJ5*01 | 1641 | gnl|Fabrus|O12_IGKJ1*01 | 1101 |
| 1971 | VH3-23_IGHD5-24*01 > 3_IGHJ5*01 | 1642 | gnl|Fabrus|O12_IGKJ1*01 | 1101 |
| 1972 | VH3-23_IGHD6-6*01 > 1_IGHJ5*01 | 1643 | gnl|Fabrus|O12_IGKJ1*01 | 1101 |
| 1973 | VH3-23_IGHD1-1*01 > 1'_IGHJ5*01 | 1653 | gnl|Fabrus|O12_IGKJ1*01 | 1101 |
| 1974 | VH3-23_IGHD1-1*01 > 2'_IGHJ5*01 | 1654 | gnl|Fabrus|O12_IGKJ1*01 | 1101 |
| 1975 | VH3-23_IGHD1-1*01 > 3'_IGHJ5*01 | 1655 | gnl|Fabrus|O12_IGKJ1*01 | 1101 |
| 1976 | VH3-23_IGHD1-7*01 > 1'_IGHJ5*01 | 1656 | gnl|Fabrus|O12_IGKJ1*01 | 1101 |
| 1977 | VH3-23_IGHD1-7*01 > 3'_IGHJ5*01 | 1657 | gnl|Fabrus|O12_IGKJ1*01 | 1101 |
| 1978 | VH3-23_IGHD1-14*01 > 1'_IGHJ5*01 | 1658 | gnl|Fabrus|O12_IGKJ1*01 | 1101 |
| 1979 | VH3-23_IGHD1-14*01 > 2'_IGHJ5*01 | 1659 | gnl|Fabrus|O12_IGKJ1*01 | 1101 |
| 1980 | VH3-23_IGHD1-14*01 > 3'_IGHJ5*01 | 1660 | gnl|Fabrus|O12_IGKJ1*01 | 1101 |
| 1981 | VH3-23_IGHD1-20*01 > 1'_IGHJ5*01 | 1661 | gnl|Fabrus|O12_IGKJ1*01 | 1101 |
| 1982 | VH3-23_IGHD1-20*01 > 2'_IGHJ5*01 | 1662 | gnl|Fabrus|O12_IGKJ1*01 | 1101 |
| 1983 | VH3-23_IGHD1-20*01 > 3'_IGHJ5*01 | 1663 | gnl|Fabrus|O12_IGKJ1*01 | 1101 |
| 1984 | VH3-23_IGHD1-26*01 > 1'_IGHJ5*01 | 1664 | gnl|Fabrus|O12_IGKJ1*01 | 1101 |
| 1985 | VH3-23_IGHD1-26*01 > 3'_IGHJ5*01 | 1665 | gnl|Fabrus|O12_IGKJ1*01 | 1101 |
| 1986 | VH3-23_IGHD2-2*01 > 1'_IGHJ5*01 | 1666 | gnl|Fabrus|O12_IGKJ1*01 | 1101 |
| 1987 | VH3-23_IGHD2-2*01 > 3'_IGHJ5*01 | 1667 | gnl|Fabrus|O12_IGKJ1*01 | 1101 |
| 1988 | VH3-23_IGHD2-8*01 > 1'_IGHJ5*01 | 1668 | gnl|Fabrus|O12_IGKJ1*01 | 1101 |
| 1989 | VH3-23_IGHD2-15*01 > 1'_IGHJ5*01 | 1669 | gnl|Fabrus|O12_IGKJ1*01 | 1101 |
| 1990 | VH3-23_IGHD2-15*01 > 3'_IGHJ5*01 | 1670 | gnl|Fabrus|O12_IGKJ1*01 | 1101 |
| 1991 | VH3-23_IGHD2-21*01 > 1'_IGHJ5*01 | 1671 | gnl|Fabrus|O12_IGKJ1*01 | 1101 |
| 1992 | VH3-23_IGHD2-21*01 > 3'_IGHJ5*01 | 1672 | gnl|Fabrus|O12_IGKJ1*01 | 1101 |
| 1993 | VH3-23_IGHD3-3*01 > 1'_IGHJ5*01 | 1673 | gnl|Fabrus|O12_IGKJ1*01 | 1101 |
| 1994 | VH3-23_IGHD3-3*01 > 3'_IGHJ5*01 | 1674 | gnl|Fabrus|O12_IGKJ1*01 | 1101 |
| 1995 | VH3-23_IGHD3-9*01 > 1'_IGHJ5*01 | 1675 | gnl|Fabrus|O12_IGKJ1*01 | 1101 |
| 1996 | VH3-23_IGHD3-9*01 > 3'_IGHJ5*01 | 1676 | gnl|Fabrus|O12_IGKJ1*01 | 1101 |
| 1997 | VH3-23_IGHD3-10*01 > 1'_IGHJ5*01 | 1677 | gnl|Fabrus|O12_IGKJ1*01 | 1101 |
| 1998 | VH3-23_IGHD3-10*01 > 3'_IGHJ5*01 | 1678 | gnl|Fabrus|O12_IGKJ1*01 | 1101 |
| 1999 | VH3-23_IGHD3-16*01 > 1'_IGHJ5*01 | 1679 | gnl|Fabrus|O12_IGKJ1*01 | 1101 |
| 2000 | VH3-23_IGHD3-16*01 > 3'_IGHJ5*01 | 1680 | gnl|Fabrus|O12_IGKJ1*01 | 1101 |
| 2001 | VH3-23_IGHD3-22*01 > 1'_IGHJ5*01 | 1681 | gnl|Fabrus|O12_IGKJ1*01 | 1101 |
| 2002 | VH3-23_IGHD4-4*01 (1) > 1'_IGHJ5*01 | 1682 | gnl|Fabrus|O12_IGKJ1*01 | 1101 |
| 2003 | VH3-23_IGHD4-4*01 (1) > 3'_IGHJ5*01 | 1683 | gnl|Fabrus|O12_IGKJ1*01 | 1101 |
| 2004 | VH3-23_IGHD4-11*01 (1) > 1'_IGHJ5*01 | 1684 | gnl|Fabrus|O12_IGKJ1*01 | 1101 |
| 2005 | VH3-23_IGHD4-11*01 (1) > 3'_IGHJ5*01 | 1685 | gnl|Fabrus|O12_IGKJ1*01 | 1101 |
| 2006 | VH3-23_IGHD4-17*01 > 1'_IGHJ5*01 | 1686 | gnl|Fabrus|O12_IGKJ1*01 | 1101 |
| 2007 | VH3-23_IGHD4-17*01 > 3'_IGHJ5*01 | 1687 | gnl|Fabrus|O12_IGKJ1*01 | 1101 |
| 2008 | VH3-23_IGHD4-23*01 > 1'_IGHJ5*01 | 1688 | gnl|Fabrus|O12_IGKJ1*01 | 1101 |
| 2009 | VH3-23_IGHD4-23*01 > 3'_IGHJ5*01 | 1689 | gnl|Fabrus|O12_IGKJ1*01 | 1101 |
| 2010 | VH3-23_IGHD5-5*01 (2) > 1'_IGHJ5*01 | 1690 | gnl|Fabrus|O12_IGKJ1*01 | 1101 |
| 2011 | VH3-23_IGHD5-5*01 (2) > 3'_IGHJ5*01 | 1691 | gnl|Fabrus|O12_IGKJ1*01 | 1101 |
| 2012 | VH3-23_IGHD5-12*01 > 1'_IGHJ5*01 | 1692 | gnl|Fabrus|O12_IGKJ1*01 | 1101 |
| 2013 | VH3-23_IGHD5-12*01 > 3'_IGHJ5*01 | 1693 | gnl|Fabrus|O12_IGKJ1*01 | 1101 |
| 2014 | VH3-23_IGHD5-18*01 (2) > 1'_IGHJ5*01 | 1694 | gnl|Fabrus|O12_IGKJ1*01 | 1101 |
| 2015 | VH3-23_IGHD5-18*01 (2) > 3'_IGHJ5*01 | 1695 | gnl|Fabrus|O12_IGKJ1*01 | 1101 |

TABLE 4-continued

Exemplary Paired Nucleic Acid Library

| HEAVY CHAIN | SEQ ID NO | LIGHT CHAIN | SEQ ID NO |
|---|---|---|---|
| 2016 VH3-23_IGHD5-24*01 > 1'_IGHJ5*01 | 1696 | gnl|Fabrus|O12_IGKJ1*01 | 1101 |
| 2017 VH3-23_IGHD5-24*01 > 3'_IGHJ5*01 | 1697 | gnl|Fabrus|O12_IGKJ1*01 | 1101 |
| 2018 VH3-23_IGHD6-6*01 > 1'_IGHJ5*01 | 1698 | gnl|Fabrus|O12_IGKJ1*01 | 1101 |
| 2019 VH3-23_IGHD6-6*01 > 2'_IGHJ5*01 | 1699 | gnl|Fabrus|O12_IGKJ1*01 | 1101 |
| 2020 VH3-23_IGHD6-6*01 > 3'_IGHJ5*01 | 1700 | gnl|Fabrus|O12_IGKJ1*01 | 1101 |
| 2021 VH3-23_IGHD6-6*01 > 2_IGHJ5*01 | 1644 | gnl|Fabrus|O12_IGKJ1*01 | 1101 |
| 2022 VH3-23_IGHD6-13*01 > 1_IGHJ5*01 | 1645 | gnl|Fabrus|O12_IGKJ1*01 | 1101 |
| 2023 VH3-23_IGHD6-13*01 > 2_IGHJ5*01 | 1646 | gnl|Fabrus|O12_IGKJ1*01 | 1101 |
| 2024 VH3-23_IGHD6-19*01 > 1_IGHJ5*01 | 1647 | gnl|Fabrus|O12_IGKJ1*01 | 1101 |
| 2025 VH3-23_IGHD6-19*01 > 2_IGHJ5*01 | 1648 | gnl|Fabrus|O12_IGKJ1*01 | 1101 |
| 2026 VH3-23_IGHD6-25*01 > 1_IGHJ5*01 | 1649 | gnl|Fabrus|O12_IGKJ1*01 | 1101 |
| 2027 VH3-23_IGHD6-25*01 > 2_IGHJ5*01 | 1650 | gnl|Fabrus|O12_IGKJ1*01 | 1101 |
| 2028 VH3-23_IGHD7-27*01 > 1_IGHJ5*01 | 1651 | gnl|Fabrus|O12_IGKJ1*01 | 1101 |
| 2029 VH3-23_IGHD7-27*01 > 3_IGHJ5*01 | 1652 | gnl|Fabrus|O12_IGKJ1*01 | 1101 |
| 2030 VH3-23_IGHD6-13*01 > 1'_IGHJ5*01 | 1701 | gnl|Fabrus|O12_IGKJ1*01 | 1101 |
| 2031 VH3-23_IGHD6-13*01 > 2'_IGHJ5*01 | 1702 | gnl|Fabrus|O12_IGKJ1*01 | 1101 |
| 2032 VH3-23_IGHD6-13*01 > 3'_IGHJ5*01 | 1703 | gnl|Fabrus|O12_IGKJ1*01 | 1101 |
| 2033 VH3-23_IGHD6-19*01 > 1'_IGHJ5*01 | 1704 | gnl|Fabrus|O12_IGKJ1*01 | 1101 |
| 2034 VH3-23_IGHD6-19*01 > 2'_IGHJ5*01 | 1705 | gnl|Fabrus|O12_IGKJ1*01 | 1101 |
| 2035 VH3-23_IGHD6-19*01 > 2_IGHJ5*01_B | 1706 | gnl|Fabrus|O12_IGKJ1*01 | 1101 |
| 2036 VH3-23_IGHD6-25*01 > 1'_IGHJ5*01 | 1707 | gnl|Fabrus|O12_IGKJ1*01 | 1101 |
| 2037 VH3-23_IGHD6-25*01 > 3'_IGHJ5*01 | 1708 | gnl|Fabrus|O12_IGKJ1*01 | 1101 |
| 2038 VH3-23_IGHD7-27*01 > 1'_IGHJ5*01 | 1709 | gnl|Fabrus|O12_IGKJ1*01 | 1101 |
| 2039 VH3-23_IGHD7-27*01 > 2'_IGHJ5*01 | 1710 | gnl|Fabrus|O12_IGKJ1*01 | 1101 |
| 2040 VH3-23_IGHD1-1*01 > 1_IGHJ6*01 | 1711 | gnl|Fabrus|O12_IGKJ1*01 | 1101 |
| 2041 VH3-23_IGHD1-1*01 > 2_IGHJ6*01 | 1712 | gnl|Fabrus|O12_IGKJ1*01 | 1101 |
| 2042 VH3-23_IGHD1-1*01 > 3_IGHJ6*01 | 1713 | gnl|Fabrus|O12_IGKJ1*01 | 1101 |
| 2043 VH3-23_IGHD1-7*01 > 1_IGHJ6*01 | 1714 | gnl|Fabrus|O12_IGKJ1*01 | 1101 |
| 2044 VH3-23_IGHD1-7*01 > 3_IGHJ6*01 | 1715 | gnl|Fabrus|O12_IGKJ1*01 | 1101 |
| 2045 VH3-23_IGHD1-14*01 > 1_IGHJ6*01 | 1716 | gnl|Fabrus|O12_IGKJ1*01 | 1101 |
| 2046 VH3-23_IGHD1-14*01 > 3_IGHJ6*01 | 1717 | gnl|Fabrus|O12_IGKJ1*01 | 1101 |
| 2047 VH3-23_IGHD1-20*01 > 1_IGHJ6*01 | 1718 | gnl|Fabrus|O12_IGKJ1*01 | 1101 |
| 2048 VH3-23_IGHD1-20*01 > 3_IGHJ6*01 | 1719 | gnl|Fabrus|O12_IGKJ1*01 | 1101 |
| 2049 VH3-23_IGHD1-26*01 > 1_IGHJ6*01 | 1720 | gnl|Fabrus|O12_IGKJ1*01 | 1101 |
| 2050 VH3-23_IGHD1-26*01 > 3_IGHJ6*01 | 1721 | gnl|Fabrus|O12_IGKJ1*01 | 1101 |
| 2051 VH3-23_IGHD2-2*01 > 2_IGHJ6*01 | 1722 | gnl|Fabrus|O12_IGKJ1*01 | 1101 |
| 2052 VH3-23_IGHD2-2*01 > 3_IGHJ6*01 | 1723 | gnl|Fabrus|O12_IGKJ1*01 | 1101 |
| 2053 VH3-23_IGHD2-8*01 > 2_IGHJ6*01 | 1724 | gnl|Fabrus|O12_IGKJ1*01 | 1101 |
| 2054 VH3-23_IGHD2-8*01 > 3_IGHJ6*01 | 1725 | gnl|Fabrus|O12_IGKJ1*01 | 1101 |
| 2055 VH3-23_IGHD2-15*01 > 2_IGHJ6*01 | 1726 | gnl|Fabrus|O12_IGKJ1*01 | 1101 |
| 2056 VH3-23_IGHD2-15*01 > 3_IGHJ6*01 | 1727 | gnl|Fabrus|O12_IGKJ1*01 | 1101 |
| 2057 VH3-23_IGHD2-21*01 > 2_IGHJ6*01 | 1728 | gnl|Fabrus|O12_IGKJ1*01 | 1101 |
| 2058 VH3-23_IGHD2-21*01 > 3_IGHJ6*01 | 1729 | gnl|Fabrus|O12_IGKJ1*01 | 1101 |
| 2059 VH3-23_IGHD3-3*01 > 1_IGHJ6*01 | 1730 | gnl|Fabrus|O12_IGKJ1*01 | 1101 |
| 2060 VH3-23_IGHD3-3*01 > 2_IGHJ6*01 | 1731 | gnl|Fabrus|O12_IGKJ1*01 | 1101 |
| 2061 VH3-23_IGHD3-3*01 > 3_IGHJ6*01 | 1732 | gnl|Fabrus|O12_IGKJ1*01 | 1101 |
| 2062 VH3-23_IGHD3-9*01 > 2_IGHJ6*01 | 1733 | gnl|Fabrus|O12_IGKJ1*01 | 1101 |
| 2063 VH3-23_IGHD3-10*01 > 2_IGHJ6*01 | 1734 | gnl|Fabrus|O12_IGKJ1*01 | 1101 |
| 2064 VH3-23_IGHD3-10*01 > 3_IGHJ6*01 | 1735 | gnl|Fabrus|O12_IGKJ1*01 | 1101 |
| 2065 VH3-23_IGHD3-16*01 > 2_IGHJ6*01 | 1736 | gnl|Fabrus|O12_IGKJ1*01 | 1101 |
| 2066 VH3-23_IGHD3-16*01 > 3_IGHJ6*01 | 1737 | gnl|Fabrus|O12_IGKJ1*01 | 1101 |
| 2067 VH3-23_IGHD3-22*01 > 2_IGHJ6*01 | 1738 | gnl|Fabrus|O12_IGKJ1*01 | 1101 |
| 2068 VH3-23_IGHD3-22*01 > 3_IGHJ6*01 | 1739 | gnl|Fabrus|O12_IGKJ1*01 | 1101 |
| 2069 VH3-23_IGHD4-4*01 (1) > 2_IGHJ6*01 | 1740 | gnl|Fabrus|O12_IGKJ1*01 | 1101 |
| 2070 VH3-23_IGHD4-4*01 (1) > 3_IGHJ6*01 | 1741 | gnl|Fabrus|O12_IGKJ1*01 | 1101 |
| 2071 VH3-23_IGHD4-11*01 (1) > 2_IGHJ6*01 | 1742 | gnl|Fabrus|O12_IGKJ1*01 | 1101 |
| 2072 VH3-23_IGHD4-11*01 (1) > 3_IGHJ6*01 | 1743 | gnl|Fabrus|O12_IGKJ1*01 | 1101 |
| 2073 VH3-23_IGHD4-17*01 > 2_IGHJ6*01 | 1744 | gnl|Fabrus|O12_IGKJ1*01 | 1101 |
| 2074 VH3-23_IGHD4-17*01 > 3_IGHJ6*01 | 1745 | gnl|Fabrus|O12_IGKJ1*01 | 1101 |
| 2075 VH3-23_IGHD4-23*01 > 2_IGHJ6*01 | 1746 | gnl|Fabrus|O12_IGKJ1*01 | 1101 |
| 2076 VH3-23_IGHD4-23*01 > 3_IGHJ6*01 | 1747 | gnl|Fabrus|O12_IGKJ1*01 | 1101 |
| 2077 VH3-23_IGHD5-5*01 (2) > 1_IGHJ6*01 | 1748 | gnl|Fabrus|O12_IGKJ1*01 | 1101 |
| 2078 VH3-23_IGHD5-5*01 (2) > 2_IGHJ6*01 | 1749 | gnl|Fabrus|O12_IGKJ1*01 | 1101 |
| 2079 VH3-23_IGHD5-5*01 (2) > 3_IGHJ6*01 | 1750 | gnl|Fabrus|O12_IGKJ1*01 | 1101 |
| 2080 VH3-23_IGHD5-12*01 > 1_IGHJ6*01 | 1751 | gnl|Fabrus|O12_IGKJ1*01 | 1101 |
| 2081 VH3-23_IGHD5-12*01 > 3_IGHJ6*01 | 1752 | gnl|Fabrus|O12_IGKJ1*01 | 1101 |
| 2082 VH3-23_IGHD5-18*01 (2) > 1_IGHJ6*01 | 1753 | gnl|Fabrus|O12_IGKJ1*01 | 1101 |
| 2083 VH3-23_IGHD5-18*01 (2) > 2_IGHJ6*01 | 1754 | gnl|Fabrus|O12_IGKJ1*01 | 1101 |
| 2084 VH3-23_IGHD5-18*01 (2) > 3_IGHJ6*01 | 1755 | gnl|Fabrus|O12_IGKJ1*01 | 1101 |
| 2085 VH3-23_IGHD5-24*01 > 1_IGHJ6*01 | 1756 | gnl|Fabrus|O12_IGKJ1*01 | 1101 |
| 2086 VH3-23_IGHD5-24*01 > 3_IGHJ6*01 | 1757 | gnl|Fabrus|O12_IGKJ1*01 | 1101 |
| 2087 VH3-23_IGHD6-6*01 > 1_IGHJ6*01 | 1758 | gnl|Fabrus|O12_IGKJ1*01 | 1101 |
| 2088 VH3-23_IGHD6-6*01 > 2_IGHJ6*01 | 1759 | gnl|Fabrus|O12_IGKJ1*01 | 1101 |
| 2089 VH3-23_IGHD5-12*01 > 3'_IGHJ6*01 | 1815 | gnl|Fabrus|O12_IGKJ1*01 | 1101 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2090 | VH3-23_IGHD5-18*01(2) > 1'_IGHJ6*01 | 1809 | gnl|Fabrus|O12_IGKJ1*01 | 1101 |
| 2091 | VH3-23_IGHD5-18*01(2) > 3'_IGHJ6*01 | 1810 | gnl|Fabrus|O12_IGKJ1*01 | 1101 |
| 2092 | VH3-23_IGHD5-24*01 > 1'_IGHJ6*01 | 1811 | gnl|Fabrus|O12_IGKJ1*01 | 1101 |
| 2093 | VH3-23_IGHD5-24*01 > 3'_IGHJ6*01 | 1812 | gnl|Fabrus|O12_IGKJ1*01 | 1101 |
| 2094 | VH3-23_IGHD6-6*01 > 1'_IGHJ6*01 | 1813 | gnl|Fabrus|O12_IGKJ1*01 | 1101 |
| 2095 | VH3-23_IGHD6-6*01 > 2'_IGHJ6*01 | 1814 | gnl|Fabrus|O12_IGKJ1*01 | 1101 |
| 2096 | VH3-23_IGHD6-6*01 > 3'_IGHJ6*01 | 1815 | gnl|Fabrus|O12_IGKJ1*01 | 1101 |
| 2097 | VH3-23_IGHD1-1*01 > 1'_IGHJ6*01 | 1768 | gnl|Fabrus|O12_IGKJ1*01 | 1101 |
| 2098 | VH3-23_IGHD1-1*01 > 2'_IGHJ6*01 | 1769 | gnl|Fabrus|O12_IGKJ1*01 | 1101 |
| 2099 | VH3-23_IGHD1-1*01 > 3'_IGHJ6*01 | 1770 | gnl|Fabrus|O12_IGKJ1*01 | 1101 |
| 2100 | VH3-23_IGHD1-7*01 > 1'_IGHJ6*01 | 1771 | gnl|Fabrus|O12_IGKJ1*01 | 1101 |
| 2101 | VH3-23_IGHD1-7*01 > 3'_IGHJ6*01 | 1772 | gnl|Fabrus|O12_IGKJ1*01 | 1101 |
| 2102 | VH3-23_IGHD1-14*01 > 1'_IGHJ6*01 | 1773 | gnl|Fabrus|O12_IGKJ1*01 | 1101 |
| 2103 | VH3-23_IGHD1-14*01 > 2'_IGHJ6*01 | 1774 | gnl|Fabrus|O12_IGKJ1*01 | 1101 |
| 2104 | VH3-23_IGHD1-14*01 > 3'_IGHJ6*01 | 1775 | gnl|Fabrus|O12_IGKJ1*01 | 1101 |
| 2105 | VH3-23_IGHD1-20*01 > 1'_IGHJ6*01 | 1776 | gnl|Fabrus|O12_IGKJ1*01 | 1101 |
| 2106 | VH3-23_IGHD1-20*01 > 2'_IGHJ6*01 | 1777 | gnl|Fabrus|O12_IGKJ1*01 | 1101 |
| 2107 | VH3-23_IGHD1-20*01 > 3'_IGHJ6*01 | 1778 | gnl|Fabrus|O12_IGKJ1*01 | 1101 |
| 2108 | VH3-23_IGHD1-26*01 > 1'_IGHJ6*01 | 1779 | gnl|Fabrus|O12_IGKJ1*01 | 1101 |
| 2109 | VH3-23_IGHD1-26*01 > 1_IGHJ6*01_B | 1780 | gnl|Fabrus|O12_IGKJ1*01 | 1101 |
| 2110 | VH3-23_IGHD2-2*01 > 2_IGHJ6*01_B | 1781 | gnl|Fabrus|O12_IGKJ1*01 | 1101 |
| 2111 | VH3-23_IGHD2-2*01 > 3'_IGHJ6*01 | 1782 | gnl|Fabrus|O12_IGKJ1*01 | 1101 |
| 2112 | VH3-23_IGHD2-8*01 > 1'_IGHJ6*01 | 1783 | gnl|Fabrus|O12_IGKJ1*01 | 1101 |
| 2113 | VH3-23_IGHD2-15*01 > 1'_IGHJ6*01 | 1784 | gnl|Fabrus|O12_IGKJ1*01 | 1101 |
| 2114 | VH3-23_IGHD2-15*01 > 3'_IGHJ6*01 | 1785 | gnl|Fabrus|O12_IGKJ1*01 | 1101 |
| 2115 | VH3-23_IGHD2-21*01 > 1'_IGHJ6*01 | 1786 | gnl|Fabrus|O12_IGKJ1*01 | 1101 |
| 2116 | VH3-23_IGHD2-21*01 > 3'_IGHJ6*01 | 1787 | gnl|Fabrus|O12_IGKJ1*01 | 1101 |
| 2117 | VH3-23_IGHD3-3*01 > 1'_IGHJ6*01 | 1788 | gnl|Fabrus|O12_IGKJ1*01 | 1101 |
| 2118 | VH3-23_IGHD3-3*01 > 3'_IGHJ6*01 | 1789 | gnl|Fabrus|O12_IGKJ1*01 | 1101 |
| 2119 | VH3-23_IGHD3-9*01 > 1'_IGHJ6*01 | 1790 | gnl|Fabrus|O12_IGKJ1*01 | 1101 |
| 2120 | VH3-23_IGHD3-9*01 > 3'_IGHJ6*01 | 1791 | gnl|Fabrus|O12_IGKJ1*01 | 1101 |
| 2121 | VH3-23_IGHD3-10*01 > 1'_IGHJ6*01 | 1792 | gnl|Fabrus|O12_IGKJ1*01 | 1101 |
| 2122 | VH3-23_IGHD3-10*01 > 3'_IGHJ6*01 | 1793 | gnl|Fabrus|O12_IGKJ1*01 | 1101 |
| 2123 | VH3-23_IGHD3-16*01 > 1'_IGHJ6*01 | 1794 | gnl|Fabrus|O12_IGKJ1*01 | 1101 |
| 2124 | VH3-23_IGHD3-16*01 > 3'_IGHJ6*01 | 1795 | gnl|Fabrus|O12_IGKJ1*01 | 1101 |
| 2125 | VH3-23_IGHD3-22*01 > 1'_IGHJ6*01 | 1796 | gnl|Fabrus|O12_IGKJ1*01 | 1101 |
| 2126 | VH3-23_IGHD4-4*01 (1) > 1'_IGHJ6*01 | 1797 | gnl|Fabrus|O12_IGKJ1*01 | 1101 |
| 2127 | VH3-23_IGHD4-4*01 (1) > 3'_IGHJ6*01 | 1798 | gnl|Fabrus|O12_IGKJ1*01 | 1101 |
| 2128 | VH3-23_IGHD4-11*01 (1) > 1'_IGHJ6*01 | 1799 | gnl|Fabrus|O12_IGKJ1*01 | 1101 |
| 2129 | VH3-23_IGHD4-11*01 (1) > 3'_IGHJ6*01 | 1800 | gnl|Fabrus|O12_IGKJ1*01 | 1101 |
| 2130 | VH3-23_IGHD4-17*01 > 1'_IGHJ6*01 | 1801 | gnl|Fabrus|O12_IGKJ1*01 | 1101 |
| 2131 | VH3-23_IGHD4-17*01 > 3'_IGHJ6*01 | 1802 | gnl|Fabrus|O12_IGKJ1*01 | 1101 |
| 2132 | VH3-23_IGHD4-23*01 > 1'_IGHJ6*01 | 1803 | gnl|Fabrus|O12_IGKJ1*01 | 1101 |
| 2133 | VH3-23_IGHD4-23*01 > 3'_IGHJ6*01 | 1804 | gnl|Fabrus|O12_IGKJ1*01 | 1101 |
| 2134 | VH3-23_IGHD5-5*01 (2) > 1'_IGHJ6*01 | 1805 | gnl|Fabrus|O12_IGKJ1*01 | 1101 |
| 2135 | VH3-23_IGHD5-5*01 (2) > 3'_IGHJ6*01 | 1806 | gnl|Fabrus|O12_IGKJ1*01 | 1101 |
| 2136 | VH3-23_IGHD5-12*01 > 1'_IGHJ6*01 | 1807 | gnl|Fabrus|O12_IGKJ1*01 | 1101 |
| 2137 | VH3-23_IGHD5-12*01 > 3'_IGHJ6*01 | 1808 | gnl|Fabrus|O12_IGKJ1*01 | 1101 |
| 2138 | VH3-23_IGHD5-18*01 (2) > 1'_IGHJ6*01 | 1809 | gnl|Fabrus|O12_IGKJ1*01 | 1101 |
| 2139 | VH3-23_IGHD5-18*01 (2) > 3'_IGHJ6*01 | 1810 | gnl|Fabrus|O12_IGKJ1*01 | 1101 |
| 2140 | VH3-23_IGHD5-24*01 > 1'_IGHJ6*01 | 1811 | gnl|Fabrus|O12_IGKJ1*01 | 1101 |
| 2141 | VH3-23_IGHD5-24*01 > 3'_IGHJ6*01 | 1812 | gnl|Fabrus|O12_IGKJ1*01 | 1101 |
| 2142 | VH3-23_IGHD6-6*01 > 1'_IGHJ6*01 | 1813 | gnl|Fabrus|O12_IGKJ1*01 | 1101 |
| 2143 | VH3-23_IGHD6-6*01 > 2'_IGHJ6*01 | 1814 | gnl|Fabrus|O12_IGKJ1*01 | 1101 |
| 2144 | VH3-23_IGHD6-6*01 > 3'_IGHJ6*01 | 1815 | gnl|Fabrus|O12_IGKJ1*01 | 1101 |
| 2145 | VH3-23_IGHD6-13*01 > 1'_IGHJ6*01 | 1816 | gnl|Fabrus|O12_IGKJ1*01 | 1101 |
| 2146 | VH3-23_IGHD6-13*01 > 2'_IGHJ6*01 | 1817 | gnl|Fabrus|O12_IGKJ1*01 | 1101 |
| 2147 | VH3-23_IGHD6-13*01 > 3'_IGHJ6*01 | 1818 | gnl|Fabrus|O12_IGKJ1*01 | 1101 |
| 2148 | VH3-23_IGHD6-19*01 > 1'_IGHJ6*01 | 1819 | gnl|Fabrus|O12_IGKJ1*01 | 1101 |
| 2149 | VH3-23_IGHD6-19*01 > 2'_IGHJ6*01 | 1820 | gnl|Fabrus|O12_IGKJ1*01 | 1101 |
| 2150 | VH3-23_IGHD6-19*01 > 3'_IGHJ6*01 | 1821 | gnl|Fabrus|O12_IGKJ1*01 | 1101 |
| 2151 | VH3-23_IGHD6-25*01 > 1'_IGHJ6*01 | 1822 | gnl|Fabrus|O12_IGKJ1*01 | 1101 |
| 2152 | VH3-23_IGHD6-25*01 > 3'_IGHJ6*01 | 1823 | gnl|Fabrus|O12_IGKJ1*01 | 1101 |
| 2153 | VH3-23_IGHD7-27*01 > 1'_IGHJ6*01 | 1824 | gnl|Fabrus|O12_IGKJ1*01 | 1101 |
| 2154 | VH3-23_IGHD7-27*01 > 2'_IGHJ6*01 | 1825 | gnl|Fabrus|O12_IGKJ1*01 | 1101 |
| 2155 | VH3-23_IGHD1-1*01 > 1_IGHJ1*01 | 1136 | gnl|Fabrus|O18_IGKJ1*01 | 1102 |
| 2156 | VH3-23_IGHD1-1*01 > 2_IGHJ1*01 | 1137 | gnl|Fabrus|O18_IGKJ1*01 | 1102 |
| 2157 | VH3-23_IGHD1-1*01 > 3_IGHJ1*01 | 1138 | gnl|Fabrus|O18_IGKJ1*01 | 1102 |
| 2158 | VH3-23_IGHD1-7*01 > 1_IGHJ1*01 | 1139 | gnl|Fabrus|O18_IGKJ1*01 | 1102 |
| 2159 | VH3-23_IGHD1-7*01 > 3_IGHJ1*01 | 1140 | gnl|Fabrus|O18_IGKJ1*01 | 1102 |
| 2160 | VH3-23_IGHD1-14*01 > 1_IGHJ1*01 | 1141 | gnl|Fabrus|O18_IGKJ1*01 | 1102 |
| 2161 | VH3-23_IGHD1-14*01 > 3_IGHJ1*01 | 1142 | gnl|Fabrus|O18_IGKJ1*01 | 1102 |
| 2162 | VH3-23_IGHD1-20*01 > 1_IGHJ1*01 | 1143 | gnl|Fabrus|O18_IGKJ1*01 | 1102 |
| 2163 | VH3-23_IGHD1-20*01 > 3_IGHJ1*01 | 1144 | gnl|Fabrus|O18_IGKJ1*01 | 1102 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2164 | VH3-23_IGHD1-26*01 > 1_IGHJ1*01 | 1145 | gnl|Fabrus|O18_IGKJ1*01 | 1102 |
| 2165 | VH3-23_IGHD1-26*01 > 3_IGHJ1*01 | 1146 | gnl|Fabrus|O18_IGKJ1*01 | 1102 |
| 2166 | VH3-23_IGHD2-2*01 > 2_IGHJ1*01 | 1147 | gnl|Fabrus|O18_IGKJ1*01 | 1102 |
| 2167 | VH3-23_IGHD2-2*01 > 3_IGHJ1*01 | 1148 | gnl|Fabrus|O18_IGKJ1*01 | 1102 |
| 2168 | VH3-23_IGHD2-8*01 > 2_IGHJ1*01 | 1149 | gnl|Fabrus|O18_IGKJ1*01 | 1102 |
| 2169 | VH3-23_IGHD2-8*01 > 3_IGHJ1*01 | 1150 | gnl|Fabrus|O18_IGKJ1*01 | 1102 |
| 2170 | VH3-23_IGHD2-15*01 > 2_IGHJ1*01 | 1151 | gnl|Fabrus|O18_IGKJ1*01 | 1102 |
| 2171 | VH3-23_IGHD2-15*01 > 3_IGHJ1*01 | 1152 | gnl|Fabrus|O18_IGKJ1*01 | 1102 |
| 2172 | VH3-23_IGHD2-21*01 > 2_IGHJ1*01 | 1153 | gnl|Fabrus|O18_IGKJ1*01 | 1102 |
| 2173 | VH3-23_IGHD2-21*01 > 3_IGHJ1*01 | 1154 | gnl|Fabrus|O18_IGKJ1*01 | 1102 |
| 2174 | VH3-23_IGHD3-3*01 > 1_IGHJ1*01 | 1155 | gnl|Fabrus|O18_IGKJ1*01 | 1102 |
| 2175 | VH3-23_IGHD3-3*01 > 2_IGHJ1*01 | 1156 | gnl|Fabrus|O18_IGKJ1*01 | 1102 |
| 2176 | VH3-23_IGHD3-3*01 > 3_IGHJ1*01 | 1157 | gnl|Fabrus|O18_IGKJ1*01 | 1102 |
| 2177 | VH3-23_IGHD3-9*01 > 2_IGHJ1*01 | 1158 | gnl|Fabrus|O18_IGKJ1*01 | 1102 |
| 2178 | VH3-23_IGHD3-10*01 > 2_IGHJ1*01 | 1159 | gnl|Fabrus|O18_IGKJ1*01 | 1102 |
| 2179 | VH3-23_IGHD3-10*01 > 3_IGHJ1*01 | 1160 | gnl|Fabrus|O18_IGKJ1*01 | 1102 |
| 2180 | VH3-23_IGHD3-16*01 > 2_IGHJ1*01 | 1161 | gnl|Fabrus|O18_IGKJ1*01 | 1102 |
| 2181 | VH3-23_IGHD3-16*01 > 3_IGHJ1*01 | 1162 | gnl|Fabrus|O18_IGKJ1*01 | 1102 |
| 2182 | VH3-23_IGHD3-22*01 > 2_IGHJ1*01 | 1163 | gnl|Fabrus|O18_IGKJ1*01 | 1102 |
| 2183 | VH3-23_IGHD3-22*01 > 3_IGHJ1*01 | 1164 | gnl|Fabrus|O18_IGKJ1*01 | 1102 |
| 2184 | VH3-23_IGHD4-4*01 (1) > 2_IGHJ1*01 | 1165 | gnl|Fabrus|O18_IGKJ1*01 | 1102 |
| 2185 | VH3-23_IGHD4-4*01 (1) > 3_IGHJ1*01 | 1166 | gnl|Fabrus|O18_IGKJ1*01 | 1102 |
| 2186 | VH3-23_IGHD4-11*01 (1) > 2_IGHJ1*01 | 1167 | gnl|Fabrus|O18_IGKJ1*01 | 1102 |
| 2187 | VH3-23_IGHD4-11*01 (1) > 3_IGHJ1*01 | 1168 | gnl|Fabrus|O18_IGKJ1*01 | 1102 |
| 2188 | VH3-23_IGHD4-17*01 > 2_IGHJ1*01 | 1169 | gnl|Fabrus|O18_IGKJ1*01 | 1102 |
| 2189 | VH3-23_IGHD4-17*01 > 3_IGHJ1*01 | 1170 | gnl|Fabrus|O18_IGKJ1*01 | 1102 |
| 2190 | VH3-23_IGHD4-23*01 > 2_IGHJ1*01 | 1171 | gnl|Fabrus|O18_IGKJ1*01 | 1102 |
| 2191 | VH3-23_IGHD4-23*01 > 3_IGHJ1*01 | 1172 | gnl|Fabrus|O18_IGKJ1*01 | 1102 |
| 2192 | VH3-23_IGHD5-5*01 (2) > 1_IGHJ1*01 | 1173 | gnl|Fabrus|O18_IGKJ1*01 | 1102 |
| 2193 | VH3-23_IGHD5-5*01 (2) > 2_IGHJ1*01 | 1174 | gnl|Fabrus|O18_IGKJ1*01 | 1102 |
| 2194 | VH3-23_IGHD5-5*01 (2) > 3_IGHJ1*01 | 1175 | gnl|Fabrus|O18_IGKJ1*01 | 1102 |
| 2195 | VH3-23_IGHD5-12*01 > 1_IGHJ1*01 | 1176 | gnl|Fabrus|O18_IGKJ1*01 | 1102 |
| 2196 | VH3-23_IGHD5-12*01 > 3_IGHJ1*01 | 1177 | gnl|Fabrus|O18_IGKJ1*01 | 1102 |
| 2197 | VH3-23_IGHD5-18*01 (2) > 1_IGHJ1*01 | 1178 | gnl|Fabrus|O18_IGKJ1*01 | 1102 |
| 2198 | VH3-23_IGHD5-18*01 (2) > 2_IGHJ1*01 | 1179 | gnl|Fabrus|O18_IGKJ1*01 | 1102 |
| 2199 | VH3-23_IGHD5-18*01 (2) > 3_IGHJ1*01 | 1180 | gnl|Fabrus|O18_IGKJ1*01 | 1102 |
| 2200 | VH3-23_IGHD5-24*01 > 1_IGHJ1*01 | 1181 | gnl|Fabrus|O18_IGKJ1*01 | 1102 |
| 2201 | VH3-23_IGHD5-24*01 > 3_IGHJ1*01 | 1182 | gnl|Fabrus|O18_IGKJ1*01 | 1102 |
| 2202 | VH3-23_IGHD6-6*01 > 1_IGHJ1*01 | 1183 | gnl|Fabrus|O18_IGKJ1*01 | 1102 |
| 2203 | VH3-23_IGHD1-1*01 > 1'_IGHJ1*01 | 1193 | gnl|Fabrus|O18_IGKJ1*01 | 1102 |
| 2204 | VH3-23_IGHD1-1*01 > 2'_IGHJ1*01 | 1194 | gnl|Fabrus|O18_IGKJ1*01 | 1102 |
| 2205 | VH3-23_IGHD1-1*01 > 3'_IGHJ1*01 | 1195 | gnl|Fabrus|O18_IGKJ1*01 | 1102 |
| 2206 | VH3-23_IGHD1-7*01 > 1'_IGHJ1*01 | 1196 | gnl|Fabrus|O18_IGKJ1*01 | 1102 |
| 2207 | VH3-23_IGHD1-7*01 > 3'_IGHJ1*01 | 1197 | gnl|Fabrus|O18_IGKJ1*01 | 1102 |
| 2208 | VH3-23_IGHD1-14*01 > 1'_IGHJ1*01 | 1198 | gnl|Fabrus|O18_IGKJ1*01 | 1102 |
| 2209 | VH3-23_IGHD1-14*01 > 2'_IGHJ1*01 | 1199 | gnl|Fabrus|O18_IGKJ1*01 | 1102 |
| 2210 | VH3-23_IGHD1-14*01 > 3'_IGHJ1*01 | 1200 | gnl|Fabrus|O18_IGKJ1*01 | 1102 |
| 2211 | VH3-23_IGHD1-20*01 > 1'_IGHJ1*01 | 1201 | gnl|Fabrus|O18_IGKJ1*01 | 1102 |
| 2212 | VH3-23_IGHD1-20*01 > 2'_IGHJ1*01 | 1202 | gnl|Fabrus|O18_IGKJ1*01 | 1102 |
| 2213 | VH3-23_IGHD1-20*01 > 3'_IGHJ1*01 | 1203 | gnl|Fabrus|O18_IGKJ1*01 | 1102 |
| 2214 | VH3-23_IGHD1-26*01 > 1'_IGHJ1*01 | 1204 | gnl|Fabrus|O18_IGKJ1*01 | 1102 |
| 2215 | VH3-23_IGHD1-26*01 > 3'_IGHJ1*01 | 1205 | gnl|Fabrus|O18_IGKJ1*01 | 1102 |
| 2216 | VH3-23_IGHD2-2*01 > 1'_IGHJ1*01 | 1206 | gnl|Fabrus|O18_IGKJ1*01 | 1102 |
| 2217 | VH3-23_IGHD2-2*01 > 3'_IGHJ1*01 | 1207 | gnl|Fabrus|O18_IGKJ1*01 | 1102 |
| 2218 | VH3-23_IGHD2-8*01 > 1'_IGHJ1*01 | 1208 | gnl|Fabrus|O18_IGKJ1*01 | 1102 |
| 2219 | VH3-23_IGHD2-15*01 > 1'_IGHJ1*01 | 1209 | gnl|Fabrus|O18_IGKJ1*01 | 1102 |
| 2220 | VH3-23_IGHD2-15*01 > 3'_IGHJ1*01 | 1210 | gnl|Fabrus|O18_IGKJ1*01 | 1102 |
| 2221 | VH3-23_IGHD2-21*01 > 1'_IGHJ1*01 | 1211 | gnl|Fabrus|O18_IGKJ1*01 | 1102 |
| 2222 | VH3-23_IGHD2-21*01 > 3'_IGHJ1*01 | 1212 | gnl|Fabrus|O18_IGKJ1*01 | 1102 |
| 2223 | VH3-23_IGHD3-3*01 > 1'_IGHJ1*01 | 1213 | gnl|Fabrus|O18_IGKJ1*01 | 1102 |
| 2224 | VH3-23_IGHD3-3*01 > 3'_IGHJ1*01 | 1214 | gnl|Fabrus|O18_IGKJ1*01 | 1102 |
| 2225 | VH3-23_IGHD3-9*01 > 1'_IGHJ1*01 | 1215 | gnl|Fabrus|O18_IGKJ1*01 | 1102 |
| 2226 | VH3-23_IGHD3-9*01 > 3'_IGHJ1*01 | 1216 | gnl|Fabrus|O18_IGKJ1*01 | 1102 |
| 2227 | VH3-23_IGHD3-10*01 > 1'_IGHJ1*01 | 1217 | gnl|Fabrus|O18_IGKJ1*01 | 1102 |
| 2228 | VH3-23_IGHD3-10*01 > 3'_IGHJ1*01 | 1218 | gnl|Fabrus|O18_IGKJ1*01 | 1102 |
| 2229 | VH3-23_IGHD3-16*01 > 1'_IGHJ1*01 | 1219 | gnl|Fabrus|O18_IGKJ1*01 | 1102 |
| 2230 | VH3-23_IGHD3-16*01 > 3'_IGHJ1*01 | 1220 | gnl|Fabrus|O18_IGKJ1*01 | 1102 |
| 2231 | VH3-23_IGHD3-22*01 > 1'_IGHJ1*01 | 1221 | gnl|Fabrus|O18_IGKJ1*01 | 1102 |
| 2232 | VH3-23_IGHD4-4*01 (1) > 1'_IGHJ1*01 | 1222 | gnl|Fabrus|O18_IGKJ1*01 | 1102 |
| 2233 | VH3-23_IGHD4-4*01 (1) > 3'_IGHJ1*01 | 1223 | gnl|Fabrus|O18_IGKJ1*01 | 1102 |
| 2234 | VH3-23_IGHD4-11*01 (1) > 1'_IGHJ1*01 | 1224 | gnl|Fabrus|O18_IGKJ1*01 | 1102 |
| 2235 | VH3-23_IGHD4-11*01 (1) > 3'_IGHJ1*01 | 1225 | gnl|Fabrus|O18_IGKJ1*01 | 1102 |
| 2236 | VH3-23_IGHD4-17*01 > 1'_IGHJ1*01 | 1226 | gnl|Fabrus|O18_IGKJ1*01 | 1102 |
| 2237 | VH3-23_IGHD4-17*01 > 3'_IGHJ1*01 | 1227 | gnl|Fabrus|O18_IGKJ1*01 | 1102 |

TABLE 4-continued

Exemplary Paired Nucleic Acid Library

| HEAVY CHAIN | SEQ ID NO | LIGHT CHAIN | SEQ ID NO |
|---|---|---|---|
| 2238 VH3-23_IGHD4-23*01 > 1'_IGHJ1*01 | 1228 | gnl\|Fabrus\|O18_IGKJ1*01 | 1102 |
| 2239 VH3-23_IGHD4-23*01 > 3'_IGHJ1*01 | 1229 | gnl\|Fabrus\|O18_IGKJ1*01 | 1102 |
| 2240 VH3-23_IGHD5-5*01 (2) > 1'_IGHJ1*01 | 1230 | gnl\|Fabrus\|O18_IGKJ1*01 | 1102 |
| 2241 VH3-23_IGHD5-5*01 (2) > 3'_IGHJ1*01 | 1231 | gnl\|Fabrus\|O18_IGKJ1*01 | 1102 |
| 2242 VH3-23_IGHD5-12*01 > 1'_IGHJ1*01 | 1232 | gnl\|Fabrus\|O18_IGKJ1*01 | 1102 |
| 2243 VH3-23_IGHD5-12*01 > 3'_IGHJ1*01 | 1233 | gnl\|Fabrus\|O18_IGKJ1*01 | 1102 |
| 2244 VH3-23_IGHD5-18*01 (2) > 1'_IGHJ1*01 | 1234 | gnl\|Fabrus\|O18_IGKJ1*01 | 1102 |
| 2245 VH3-23_IGHD5-18*01 (2) > 3'_IGHJ1*01 | 1235 | gnl\|Fabrus\|O18_IGKJ1*01 | 1102 |
| 2246 VH3-23_IGHD5-24*01 > 1'_IGHJ1*01 | 1236 | gnl\|Fabrus\|O18_IGKJ1*01 | 1102 |
| 2247 VH3-23_IGHD5-24*01 > 3'_IGHJ1*01 | 1237 | gnl\|Fabrus\|O18_IGKJ1*01 | 1102 |
| 2248 VH3-23_IGHD6-6*01 > 1'_IGHJ1*01 | 1238 | gnl\|Fabrus\|O18_IGKJ1*01 | 1102 |
| 2249 VH3-23_IGHD6-6*01 > 2'_IGHJ1*01 | 1239 | gnl\|Fabrus\|O18_IGKJ1*01 | 1102 |
| 2250 VH3-23_IGHD6-6*01 > 3'_IGHJ1*01 | 1240 | gnl\|Fabrus\|O18_IGKJ1*01 | 1102 |
| 2251 VH3-23_IGHD7-27*01 > 1'_IGHJ6*01 | 1824 | gnl\|Fabrus\|O18_IGKJ1*01 | 1102 |
| 2252 VH3-23_IGHD6-13*01 > 2_IGHJ6*01 | 1761 | gnl\|Fabrus\|O18_IGKJ1*01 | 1102 |
| 2253 VH3-23_IGHD6-19*01 > 1_IGHJ6*01 | 1762 | gnl\|Fabrus\|O18_IGKJ1*01 | 1102 |
| 2254 VH3-23_IGHD6-19*01 > 2_IGHJ6*01 | 1763 | gnl\|Fabrus\|O18_IGKJ1*01 | 1102 |
| 2255 VH3-23_IGHD6-25*01 > 1_IGHJ6*01 | 1764 | gnl\|Fabrus\|O18_IGKJ1*01 | 1102 |
| 2256 VH3-23_IGHD6-25*01 > 2_IGHJ6*01 | 1765 | gnl\|Fabrus\|O18_IGKJ1*01 | 1102 |
| 2257 VH3-23_IGHD7-27*01 > 1_IGHJ6*01 | 1766 | gnl\|Fabrus\|O18_IGKJ1*01 | 1102 |
| 2258 VH3-23_IGHD7-27*01 > 3_IGHJ6*01 | 1767 | gnl\|Fabrus\|O18_IGKJ1*01 | 1102 |
| 2259 VH3-23_IGHD6-13*01 > 1'_IGHJ6*01 | 1816 | gnl\|Fabrus\|O18_IGKJ1*01 | 1102 |
| 2260 VH3-23_IGHD6-13*01 > 2'_IGHJ6*01 | 1817 | gnl\|Fabrus\|O18_IGKJ1*01 | 1102 |
| 2261 VH3-23_IGHD6-13*01 > 2_IGHJ6*01_B | 1761 | gnl\|Fabrus\|O18_IGKJ1*01 | 1102 |
| 2262 VH3-23_IGHD6-19*01 > 1'_IGHJ6*01 | 1819 | gnl\|Fabrus\|O18_IGKJ1*01 | 1102 |
| 2263 VH3-23_IGHD6-19*01 > 2'_IGHJ6*01 | 1820 | gnl\|Fabrus\|O18_IGKJ1*01 | 1102 |
| 2264 VH3-23_IGHD6-25*01 > 1_IGHJ6*01_B | 1764 | gnl\|Fabrus\|O18_IGKJ1*01 | 1102 |
| 2265 VH3-23_IGHD6-25*01 > 1'_IGHJ6*01 | 1822 | gnl\|Fabrus\|O18_IGKJ1*01 | 1102 |
| 2266 VH3-23_IGHD6-25*01 > 3'_IGHJ6*01 | 1823 | gnl\|Fabrus\|O18_IGKJ1*01 | 1102 |
| 2267 VH3-23_IGHD7-27*01 > 1'_IGHJ6*01 | 1824 | gnl\|Fabrus\|O18_IGKJ1*01 | 1102 |
| 2268 VH3-23_IGHD7-27*01 > 2'_IGHJ6*01 | 1825 | gnl\|Fabrus\|O18_IGKJ1*01 | 1102 |
| 2269 VH3-23_IGHD7-27*01 > 1'_IGHJ6*01 | 1824 | gnl\|Fabrus\|A20_IGKJ1*01 | 1077 |
| 2270 VH3-23_IGHD6-13*01 > 2_IGHJ6*01 | 1761 | gnl\|Fabrus\|A20_IGKJ1*01 | 1077 |
| 2271 VH3-23_IGHD6-19*01 > 1_IGHJ6*01 | 1762 | gnl\|Fabrus\|A20_IGKJ1*01 | 1077 |
| 2272 VH3-23_IGHD6-19*01 > 2_IGHJ6*01 | 1763 | gnl\|Fabrus\|A20_IGKJ1*01 | 1077 |
| 2273 VH3-23_IGHD6-25*01 > 1_IGHJ6*01 | 1764 | gnl\|Fabrus\|A20_IGKJ1*01 | 1077 |
| 2274 VH3-23_IGHD6-25*01 > 2_IGHJ6*01 | 1765 | gnl\|Fabrus\|A20_IGKJ1*01 | 1077 |
| 2275 VH3-23_IGHD7-27*01 > 1_IGHJ6*01 | 1766 | gnl\|Fabrus\|A20_IGKJ1*01 | 1077 |
| 2276 VH3-23_IGHD7-27*01 > 3_IGHJ6*01 | 1767 | gnl\|Fabrus\|A20_IGKJ1*01 | 1077 |
| 2277 VH3-23_IGHD6-13*01 > 1'_IGHJ6*01 | 1816 | gnl\|Fabrus\|A20_IGKJ1*01 | 1077 |
| 2278 VH3-23_IGHD6-13*01 > 2'_IGHJ6*01 | 1817 | gnl\|Fabrus\|A20_IGKJ1*01 | 1077 |
| 2279 VH3-23_IGHD6-13*01 > 2_IGHJ6*01_B | 1761 | gnl\|Fabrus\|A20_IGKJ1*01 | 1077 |
| 2280 VH3-23_IGHD6-19*01 > 1'_IGHJ6*01 | 1819 | gnl\|Fabrus\|A20_IGKJ1*01 | 1077 |
| 2281 VH3-23_IGHD6-19*01 > 2'_IGHJ6*01 | 1820 | gnl\|Fabrus\|A20_IGKJ1*01 | 1077 |
| 2282 VH3-23_IGHD6-25*01 > 1_IGHJ6*01_B | 1764 | gnl\|Fabrus\|A20_IGKJ1*01 | 1077 |
| 2283 VH3-23_IGHD6-25*01 > 1'_IGHJ6*01 | 1822 | gnl\|Fabrus\|A20_IGKJ1*01 | 1077 |
| 2284 VH3-23_IGHD6-25*01 > 3'_IGHJ6*01 | 1823 | gnl\|Fabrus\|A20_IGKJ1*01 | 1077 |
| 2285 VH3-23_IGHD7-27*01 > 1'_IGHJ6*01 | 1824 | gnl\|Fabrus\|A20_IGKJ1*01 | 1077 |
| 2286 VH3-23_IGHD7-27*01 > 2'_IGHJ6*01 | 1825 | gnl\|Fabrus\|A20_IGKJ1*01 | 1077 |
| 2287 VH3-23_IGHD1-1*01 > 1_IGHJ6*01 | 1711 | gnl\|Fabrus\|L11_IGKJ1*01 | 1087 |
| 2288 VH3-23_IGHD1-1*01 > 2_IGHJ6*01 | 1712 | gnl\|Fabrus\|L11_IGKJ1*01 | 1087 |
| 2289 VH3-23_IGHD1-1*01 > 3_IGHJ6*01 | 1713 | gnl\|Fabrus\|L11_IGKJ1*01 | 1087 |
| 2290 VH3-23_IGHD1-7*01 > 1_IGHJ6*01 | 1714 | gnl\|Fabrus\|L11_IGKJ1*01 | 1087 |
| 2291 VH3-23_IGHD1-7*01 > 3_IGHJ6*01 | 1715 | gnl\|Fabrus\|L11_IGKJ1*01 | 1087 |
| 2292 VH3-23_IGHD1-14*01 > 1_IGHJ6*01 | 1716 | gnl\|Fabrus\|L11_IGKJ1*01 | 1087 |
| 2293 VH3-23_IGHD1-14*01 > 3_IGHJ6*01 | 1717 | gnl\|Fabrus\|L11_IGKJ1*01 | 1087 |
| 2294 VH3-23_IGHD1-20*01 > 1_IGHJ6*01 | 1718 | gnl\|Fabrus\|L11_IGKJ1*01 | 1087 |
| 2295 VH3-23_IGHD1-20*01 > 3_IGHJ6*01 | 1719 | gnl\|Fabrus\|L11_IGKJ1*01 | 1087 |
| 2296 VH3-23_IGHD1-26*01 > 1_IGHJ6*01 | 1720 | gnl\|Fabrus\|L11_IGKJ1*01 | 1087 |
| 2297 VH3-23_IGHD1-26*01 > 3_IGHJ6*01 | 1721 | gnl\|Fabrus\|L11_IGKJ1*01 | 1087 |
| 2298 VH3-23_IGHD2-2*01 > 2_IGHJ6*01 | 1722 | gnl\|Fabrus\|L11_IGKJ1*01 | 1087 |
| 2299 VH3-23_IGHD2-2*01 > 3_IGHJ6*01 | 1723 | gnl\|Fabrus\|L11_IGKJ1*01 | 1087 |
| 2300 VH3-23_IGHD2-8*01 > 2_IGHJ6*01 | 1724 | gnl\|Fabrus\|L11_IGKJ1*01 | 1087 |
| 2301 VH3-23_IGHD2-8*01 > 3_IGHJ6*01 | 1725 | gnl\|Fabrus\|L11_IGKJ1*01 | 1087 |
| 2302 VH3-23_IGHD2-15*01 > 2_IGHJ6*01 | 1726 | gnl\|Fabrus\|L11_IGKJ1*01 | 1087 |
| 2303 VH3-23_IGHD2-15*01 > 3_IGHJ6*01 | 1727 | gnl\|Fabrus\|L11_IGKJ1*01 | 1087 |
| 2304 VH3-23_IGHD2-21*01 > 2_IGHJ6*01 | 1728 | gnl\|Fabrus\|L11_IGKJ1*01 | 1087 |
| 2305 VH3-23_IGHD2-21*01 > 3_IGHJ6*01 | 1729 | gnl\|Fabrus\|L11_IGKJ1*01 | 1087 |
| 2306 VH3-23_IGHD3-3*01 > 1_IGHJ6*01 | 1730 | gnl\|Fabrus\|L11_IGKJ1*01 | 1087 |
| 2307 VH3-23_IGHD3-3*01 > 2_IGHJ6*01 | 1731 | gnl\|Fabrus\|L11_IGKJ1*01 | 1087 |
| 2308 VH3-23_IGHD3-3*01 > 3_IGHJ6*01 | 1732 | gnl\|Fabrus\|L11_IGKJ1*01 | 1087 |
| 2309 VH3-23_IGHD3-9*01 > 2_IGHJ6*01 | 1733 | gnl\|Fabrus\|L11_IGKJ1*01 | 1087 |
| 2310 VH3-23_IGHD3-10*01 > 2_IGHJ6*01 | 1734 | gnl\|Fabrus\|L11_IGKJ1*01 | 1087 |
| 2311 VH3-23_IGHD3-10*01 > 3_IGHJ6*01 | 1735 | gnl\|Fabrus\|L11_IGKJ1*01 | 1087 |

TABLE 4-continued

Exemplary Paired Nucleic Acid Library

| HEAVY CHAIN | SEQ ID NO | LIGHT CHAIN | SEQ ID NO |
|---|---|---|---|
| 2312 VH3-23_IGHD3-16*01 > 2_IGHJ6*01 | 1736 | gnl|Fabrus|L11_IGKJ1*01 | 1087 |
| 2313 VH3-23_IGHD3-16*01 > 3_IGHJ6*01 | 1737 | gnl|Fabrus|L11_IGKJ1*01 | 1087 |
| 2314 VH3-23_IGHD3-22*01 > 2_IGHJ6*01 | 1738 | gnl|Fabrus|L11_IGKJ1*01 | 1087 |
| 2315 VH3-23_IGHD3-22*01 > 3_IGHJ6*01 | 1739 | gnl|Fabrus|L11_IGKJ1*01 | 1087 |
| 2316 VH3-23_IGHD4-4*01 (1) > 2_IGHJ6*01 | 1740 | gnl|Fabrus|L11_IGKJ1*01 | 1087 |
| 2317 VH3-23_IGHD4-4*01 (1) > 3_IGHJ6*01 | 1741 | gnl|Fabrus|L11_IGKJ1*01 | 1087 |
| 2318 VH3-23_IGHD4-11*01 (1) > 2_IGHJ6*01 | 1742 | gnl|Fabrus|L11_IGKJ1*01 | 1087 |
| 2319 VH3-23_IGHD4-11*01 (1) > 3_IGHJ6*01 | 1743 | gnl|Fabrus|L11_IGKJ1*01 | 1087 |
| 2320 VH3-23_IGHD4-17*01 > 2_IGHJ6*01 | 1744 | gnl|Fabrus|L11_IGKJ1*01 | 1087 |
| 2321 VH3-23_IGHD4-17*01 > 3_IGHJ6*01 | 1745 | gnl|Fabrus|L11_IGKJ1*01 | 1087 |
| 2322 VH3-23_IGHD4-23*01 > 2_IGHJ6*01 | 1746 | gnl|Fabrus|L11_IGKJ1*01 | 1087 |
| 2323 VH3-23_IGHD4-23*01 > 3_IGHJ6*01 | 1747 | gnl|Fabrus|L11_IGKJ1*01 | 1087 |
| 2324 VH3-23_IGHD5-5*01 (2) > 1_IGHJ6*01 | 1748 | gnl|Fabrus|L11_IGKJ1*01 | 1087 |
| 2325 VH3-23_IGHD5-5*01 (2) > 2_IGHJ6*01 | 1749 | gnl|Fabrus|L11_IGKJ1*01 | 1087 |
| 2326 VH3-23_IGHD5-5*01 (2) > 3_IGHJ6*01 | 1750 | gnl|Fabrus|L11_IGKJ1*01 | 1087 |
| 2327 VH3-23_IGHD5-12*01 > 1_IGHJ6*01 | 1751 | gnl|Fabrus|L11_IGKJ1*01 | 1087 |
| 2328 VH3-23_IGHD5-12*01 > 3_IGHJ6*01 | 1752 | gnl|Fabrus|L11_IGKJ1*01 | 1087 |
| 2329 VH3-23_IGHD5-18*01 (2) > 1_IGHJ6*01 | 1753 | gnl|Fabrus|L11_IGKJ1*01 | 1087 |
| 2330 VH3-23_IGHD5-18*01 (2) > 2_IGHJ6*01 | 1754 | gnl|Fabrus|L11_IGKJ1*01 | 1087 |
| 2331 VH3-23_IGHD5-18*01 (2) > 3_IGHJ6*01 | 1755 | gnl|Fabrus|L11_IGKJ1*01 | 1087 |
| 2332 VH3-23_IGHD5-24*01 > 1_IGHJ6*01 | 1756 | gnl|Fabrus|L11_IGKJ1*01 | 1087 |
| 2333 VH3-23_IGHD5-24*01 > 3_IGHJ6*01 | 1757 | gnl|Fabrus|L11_IGKJ1*01 | 1087 |
| 2334 VH3-23_IGHD6-6*01 > 1_IGHJ6*01 | 1758 | gnl|Fabrus|L11_IGKJ1*01 | 1087 |
| 2335 VH3-23_IGHD1-1*01 > 1'_IGHJ6*01 | 1768 | gnl|Fabrus|L11_IGKJ1*01 | 1087 |
| 2336 VH3-23_IGHD1-1*01 > 2'_IGHJ6*01 | 1769 | gnl|Fabrus|L11_IGKJ1*01 | 1087 |
| 2337 VH3-23_IGHD1-1*01 > 3'_IGHJ6*01 | 1770 | gnl|Fabrus|L11_IGKJ1*01 | 1087 |
| 2338 VH3-23_IGHD1-7*01 > 1'_IGHJ6*01 | 1771 | gnl|Fabrus|L11_IGKJ1*01 | 1087 |
| 2339 VH3-23_IGHD1-7*01 > 3'_IGHJ6*01 | 1772 | gnl|Fabrus|L11_IGKJ1*01 | 1087 |
| 2340 VH3-23_IGHD1-14*01 > 1'_IGHJ6*01 | 1773 | gnl|Fabrus|L11_IGKJ1*01 | 1087 |
| 2341 VH3-23_IGHD1-14*01 > 2'_IGHJ6*01 | 1774 | gnl|Fabrus|L11_IGKJ1*01 | 1087 |
| 2342 VH3-23_IGHD1-14*01 > 3'_IGHJ6*01 | 1775 | gnl|Fabrus|L11_IGKJ1*01 | 1087 |
| 2343 VH3-23_IGHD1-20*01 > 1'_IGHJ6*01 | 1776 | gnl|Fabrus|L11_IGKJ1*01 | 1087 |
| 2344 VH3-23_IGHD1-20*01 > 2'_IGHJ6*01 | 1777 | gnl|Fabrus|L11_IGKJ1*01 | 1087 |
| 2345 VH3-23_IGHD1-20*01 > 3'_IGHJ6*01 | 1778 | gnl|Fabrus|L11_IGKJ1*01 | 1087 |
| 2346 VH3-23_IGHD1-26*01 > 1'_IGHJ6*01 | 1779 | gnl|Fabrus|L11_IGKJ1*01 | 1087 |
| 2347 VH3-23_IGHD1-26*01 > 1_IGHJ6*01_B | 1780 | gnl|Fabrus|L11_IGKJ1*01 | 1087 |
| 2348 VH3-23_IGHD2-2*01 > 2_IGHJ6*01_B | 1781 | gnl|Fabrus|L11_IGKJ1*01 | 1087 |
| 2349 VH3-23_IGHD2-2*01 > 3_IGHJ6*01 | 1782 | gnl|Fabrus|L11_IGKJ1*01 | 1087 |
| 2350 VH3-23_IGHD2-8*01 > 1'_IGHJ6*01 | 1783 | gnl|Fabrus|L11_IGKJ1*01 | 1087 |
| 2351 VH3-23_IGHD2-15*01 > 1'_IGHJ6*01 | 1784 | gnl|Fabrus|L11_IGKJ1*01 | 1087 |
| 2352 VH3-23_IGHD2-15*01 > 3'_IGHJ6*01 | 1785 | gnl|Fabrus|L11_IGKJ1*01 | 1087 |
| 2353 VH3-23_IGHD2-21*01 > 1'_IGHJ6*01 | 1786 | gnl|Fabrus|L11_IGKJ1*01 | 1087 |
| 2354 VH3-23_IGHD2-21*01 > 3'_IGHJ6*01 | 1787 | gnl|Fabrus|L11_IGKJ1*01 | 1087 |
| 2355 VH3-23_IGHD3-3*01 > 1'_IGHJ6*01 | 1788 | gnl|Fabrus|L11_IGKJ1*01 | 1087 |
| 2356 VH3-23_IGHD3-3*01 > 3'_IGHJ6*01 | 1789 | gnl|Fabrus|L11_IGKJ1*01 | 1087 |
| 2357 VH3-23_IGHD3-9*01 > 1'_IGHJ6*01 | 1790 | gnl|Fabrus|L11_IGKJ1*01 | 1087 |
| 2358 VH3-23_IGHD3-9*01 > 3'_IGHJ6*01 | 1791 | gnl|Fabrus|L11_IGKJ1*01 | 1087 |
| 2359 VH3-23_IGHD3-10*01 > 1'_IGHJ6*01 | 1792 | gnl|Fabrus|L11_IGKJ1*01 | 1087 |
| 2360 VH3-23_IGHD3-10*01 > 3'_IGHJ6*01 | 1793 | gnl|Fabrus|L11_IGKJ1*01 | 1087 |
| 2361 VH3-23_IGHD3-16*01 > 1'_IGHJ6*01 | 1794 | gnl|Fabrus|L11_IGKJ1*01 | 1087 |
| 2362 VH3-23_IGHD3-16*01 > 3'_IGHJ6*01 | 1795 | gnl|Fabrus|L11_IGKJ1*01 | 1087 |
| 2363 VH3-23_IGHD3-22*01 > 1'_IGHJ6*01 | 1796 | gnl|Fabrus|L11_IGKJ1*01 | 1087 |
| 2364 VH3-23_IGHD4-4*01 (1) > 1'_IGHJ6*01 | 1797 | gnl|Fabrus|L11_IGKJ1*01 | 1087 |
| 2365 VH3-23_IGHD4-4*01 (1) > 3'_IGHJ6*01 | 1798 | gnl|Fabrus|L11_IGKJ1*01 | 1087 |
| 2366 VH3-23_IGHD4-11*01 (1) > 1'_IGHJ6*01 | 1799 | gnl|Fabrus|L11_IGKJ1*01 | 1087 |
| 2367 VH3-23_IGHD4-11*01 (1) > 3'_IGHJ6*01 | 1800 | gnl|Fabrus|L11_IGKJ1*01 | 1087 |
| 2368 VH3-23_IGHD4-17*01 > 1'_IGHJ6*01 | 1801 | gnl|Fabrus|L11_IGKJ1*01 | 1087 |
| 2369 VH3-23_IGHD4-17*01 > 3'_IGHJ6*01 | 1802 | gnl|Fabrus|L11_IGKJ1*01 | 1087 |
| 2370 VH3-23_IGHD4-23*01 > 1'_IGHJ6*01 | 1803 | gnl|Fabrus|L11_IGKJ1*01 | 1087 |
| 2371 VH3-23_IGHD4-23*01 > 3'_IGHJ6*01 | 1804 | gnl|Fabrus|L11_IGKJ1*01 | 1087 |
| 2372 VH3-23_IGHD5-5*01 (2) > 1'_IGHJ6*01 | 1805 | gnl|Fabrus|L11_IGKJ1*01 | 1087 |
| 2373 VH3-23_IGHD5-5*01 (2) > 3'_IGHJ6*01 | 1806 | gnl|Fabrus|L11_IGKJ1*01 | 1087 |
| 2374 VH3-23_IGHD5-12*01 > 1'_IGHJ6*01 | 1807 | gnl|Fabrus|L11_IGKJ1*01 | 1087 |
| 2375 VH3-23_IGHD5-12*01 > 3'_IGHJ6*01 | 1808 | gnl|Fabrus|L11_IGKJ1*01 | 1087 |
| 2376 VH3-23_IGHD5-18*01 (2) > 1'_IGHJ6*01 | 1809 | gnl|Fabrus|L11_IGKJ1*01 | 1087 |
| 2377 VH3-23_IGHD5-18*01 (2) > 3'_IGHJ6*01 | 1810 | gnl|Fabrus|L11_IGKJ1*01 | 1087 |
| 2378 VH3-23_IGHD5-24*01 > 1'_IGHJ6*01 | 1811 | gnl|Fabrus|L11_IGKJ1*01 | 1087 |
| 2379 VH3-23_IGHD5-24*01 > 3'_IGHJ6*01 | 1812 | gnl|Fabrus|L11_IGKJ1*01 | 1087 |
| 2380 VH3-23_IGHD6-6*01 > 1'_IGHJ6*01 | 1813 | gnl|Fabrus|L11_IGKJ1*01 | 1087 |
| 2381 VH3-23_IGHD6-6*01 > 2'_IGHJ6*01 | 1814 | gnl|Fabrus|L11_IGKJ1*01 | 1087 |
| 2382 VH3-23_IGHD6-6*01 > 3'_IGHJ6*01 | 1815 | gnl|Fabrus|L11_IGKJ1*01 | 1087 |
| 2383 VH3-23_IGHD1-1*01 > 1_IGHJ6*01 | 1711 | gnl|Fabrus|L12_IGKJ1*01 | 1088 |
| 2384 VH3-23_IGHD1-1*01 > 2_IGHJ6*01 | 1712 | gnl|Fabrus|L12_IGKJ1*01 | 1088 |
| 2385 VH3-23_IGHD1-1*01 > 3_IGHJ6*01 | 1713 | gnl|Fabrus|L12_IGKJ1*01 | 1088 |

TABLE 4-continued

Exemplary Paired Nucleic Acid Library

| HEAVY CHAIN | SEQ ID NO | LIGHT CHAIN | SEQ ID NO |
|---|---|---|---|
| 2386 VH3-23_IGHD1-7*01 > 1_IGHJ6*01 | 1714 | gnl|Fabrus|L12_IGKJ1*01 | 1088 |
| 2387 VH3-23_IGHD1-7*01 > 3_IGHJ6*01 | 1715 | gnl|Fabrus|L12_IGKJ1*01 | 1088 |
| 2388 VH3-23_IGHD1-14*01 > 1_IGHJ6*01 | 1716 | gnl|Fabrus|L12_IGKJ1*01 | 1088 |
| 2389 VH3-23_IGHD1-14*01 > 3_IGHJ6*01 | 1717 | gnl|Fabrus|L12_IGKJ1*01 | 1088 |
| 2390 VH3-23_IGHD1-20*01 > 1_IGHJ6*01 | 1718 | gnl|Fabrus|L12_IGKJ1*01 | 1088 |
| 2391 VH3-23_IGHD1-20*01 > 3_IGHJ6*01 | 1719 | gnl|Fabrus|L12_IGKJ1*01 | 1088 |
| 2392 VH3-23_IGHD1-26*01 > 1_IGHJ6*01 | 1720 | gnl|Fabrus|L12_IGKJ1*01 | 1088 |
| 2393 VH3-23_IGHD1-26*01 > 3_IGHJ6*01 | 1721 | gnl|Fabrus|L12_IGKJ1*01 | 1088 |
| 2394 VH3-23_IGHD2-2*01 > 2_IGHJ6*01 | 1722 | gnl|Fabrus|L12_IGKJ1*01 | 1088 |
| 2395 VH3-23_IGHD2-2*01 > 3_IGHJ6*01 | 1723 | gnl|Fabrus|L12_IGKJ1*01 | 1088 |
| 2396 VH3-23_IGHD2-8*01 > 2_IGHJ6*01 | 1724 | gnl|Fabrus|L12_IGKJ1*01 | 1088 |
| 2397 VH3-23_IGHD2-8*01 > 3_IGHJ6*01 | 1725 | gnl|Fabrus|L12_IGKJ1*01 | 1088 |
| 2398 VH3-23_IGHD2-15*01 > 2_IGHJ6*01 | 1726 | gnl|Fabrus|L12_IGKJ1*01 | 1088 |
| 2399 VH3-23_IGHD2-15*01 > 3_IGHJ6*01 | 1727 | gnl|Fabrus|L12_IGKJ1*01 | 1088 |
| 2400 VH3-23_IGHD2-21*01 > 2_IGHJ6*01 | 1728 | gnl|Fabrus|L12_IGKJ1*01 | 1088 |
| 2401 VH3-23_IGHD2-21*01 > 3_IGHJ6*01 | 1729 | gnl|Fabrus|L12_IGKJ1*01 | 1088 |
| 2402 VH3-23_IGHD3-3*01 > 1_IGHJ6*01 | 1730 | gnl|Fabrus|L12_IGKJ1*01 | 1088 |
| 2403 VH3-23_IGHD3-3*01 > 2_IGHJ6*01 | 1731 | gnl|Fabrus|L12_IGKJ1*01 | 1088 |
| 2404 VH3-23_IGHD3-3*01 > 3_IGHJ6*01 | 1732 | gnl|Fabrus|L12_IGKJ1*01 | 1088 |
| 2405 VH3-23_IGHD3-9*01 > 2_IGHJ6*01 | 1733 | gnl|Fabrus|L12_IGKJ1*01 | 1088 |
| 2406 VH3-23_IGHD3-10*01 > 2_IGHJ6*01 | 1734 | gnl|Fabrus|L12_IGKJ1*01 | 1088 |
| 2407 VH3-23_IGHD3-10*01 > 3_IGHJ6*01 | 1735 | gnl|Fabrus|L12_IGKJ1*01 | 1088 |
| 2408 VH3-23_IGHD3-16*01 > 2_IGHJ6*01 | 1736 | gnl|Fabrus|L12_IGKJ1*01 | 1088 |
| 2409 VH3-23_IGHD3-16*01 > 3_IGHJ6*01 | 1737 | gnl|Fabrus|L12_IGKJ1*01 | 1088 |
| 2410 VH3-23_IGHD3-22*01 > 2_IGHJ6*01 | 1738 | gnl|Fabrus|L12_IGKJ1*01 | 1088 |
| 2411 VH3-23_IGHD3-22*01 > 3_IGHJ6*01 | 1739 | gnl|Fabrus|L12_IGKJ1*01 | 1088 |
| 2412 VH3-23_IGHD4-4*01 (1) > 2_IGHJ6*01 | 1740 | gnl|Fabrus|L12_IGKJ1*01 | 1088 |
| 2413 VH3-23_IGHD4-4*01 (1) > 3_IGHJ6*01 | 1741 | gnl|Fabrus|L12_IGKJ1*01 | 1088 |
| 2414 VH3-23_IGHD4-11*01 (1) > 2_IGHJ6*01 | 1742 | gnl|Fabrus|L12_IGKJ1*01 | 1088 |
| 2415 VH3-23_IGHD4-11*01 (1) > 3_IGHJ6*01 | 1743 | gnl|Fabrus|L12_IGKJ1*01 | 1088 |
| 2416 VH3-23_IGHD4-17*01 > 2_IGHJ6*01 | 1744 | gnl|Fabrus|L12_IGKJ1*01 | 1088 |
| 2417 VH3-23_IGHD4-17*01 > 3_IGHJ6*01 | 1745 | gnl|Fabrus|L12_IGKJ1*01 | 1088 |
| 2418 VH3-23_IGHD4-23*01 > 2_IGHJ6*01 | 1746 | gnl|Fabrus|L12_IGKJ1*01 | 1088 |
| 2419 VH3-23_IGHD4-23*01 > 3_IGHJ6*01 | 1747 | gnl|Fabrus|L12_IGKJ1*01 | 1088 |
| 2420 VH3-23_IGHD5-5*01 (2) > 1_IGHJ6*01 | 1748 | gnl|Fabrus|L12_IGKJ1*01 | 1088 |
| 2421 VH3-23_IGHD5-5*01 (2) > 2_IGHJ6*01 | 1749 | gnl|Fabrus|L12_IGKJ1*01 | 1088 |
| 2422 VH3-23_IGHD5-5*01 (2) > 3_IGHJ6*01 | 1750 | gnl|Fabrus|L12_IGKJ1*01 | 1088 |
| 2423 VH3-23_IGHD5-12*01 > 1_IGHJ6*01 | 1751 | gnl|Fabrus|L12_IGKJ1*01 | 1088 |
| 2424 VH3-23_IGHD5-12*01 > 3_IGHJ6*01 | 1752 | gnl|Fabrus|L12_IGKJ1*01 | 1088 |
| 2425 VH3-23_IGHD5-18*01 (2) > 1_IGHJ6*01 | 1753 | gnl|Fabrus|L12_IGKJ1*01 | 1088 |
| 2426 VH3-23_IGHD5-18*01 (2) > 2_IGHJ6*01 | 1754 | gnl|Fabrus|L12_IGKJ1*01 | 1088 |
| 2427 VH3-23_IGHD5-18*01 (2) > 3_IGHJ6*01 | 1755 | gnl|Fabrus|L12_IGKJ1*01 | 1088 |
| 2428 VH3-23_IGHD5-24*01 > 1_IGHJ6*01 | 1756 | gnl|Fabrus|L12_IGKJ1*01 | 1088 |
| 2429 VH3-23_IGHD5-24*01 > 3_IGHJ6*01 | 1757 | gnl|Fabrus|L12_IGKJ1*01 | 1088 |
| 2430 VH3-23_IGHD6-6*01 > 1_IGHJ6*01 | 1758 | gnl|Fabrus|L12_IGKJ1*01 | 1088 |
| 2431 VH3-23_IGHD1-1*01 > 1'_IGHJ6*01 | 1768 | gnl|Fabrus|L12_IGKJ1*01 | 1088 |
| 2432 VH3-23_IGHD1-1*01 > 2'_IGHJ6*01 | 1769 | gnl|Fabrus|L12_IGKJ1*01 | 1088 |
| 2433 VH3-23_IGHD1-1*01 > 3'_IGHJ6*01 | 1770 | gnl|Fabrus|L12_IGKJ1*01 | 1088 |
| 2434 VH3-23_IGHD1-7*01 > 1'_IGHJ6*01 | 1771 | gnl|Fabrus|L12_IGKJ1*01 | 1088 |
| 2435 VH3-23_IGHD1-7*01 > 3'_IGHJ6*01 | 1772 | gnl|Fabrus|L12_IGKJ1*01 | 1088 |
| 2436 VH3-23_IGHD1-14*01 > 1'_IGHJ6*01 | 1773 | gnl|Fabrus|L12_IGKJ1*01 | 1088 |
| 2437 VH3-23_IGHD1-14*01 > 2'_IGHJ6*01 | 1774 | gnl|Fabrus|L12_IGKJ1*01 | 1088 |
| 2438 VH3-23_IGHD1-14*01 > 3'_IGHJ6*01 | 1775 | gnl|Fabrus|L12_IGKJ1*01 | 1088 |
| 2439 VH3-23_IGHD1-20*01 > 1'_IGHJ6*01 | 1776 | gnl|Fabrus|L12_IGKJ1*01 | 1088 |
| 2440 VH3-23_IGHD1-20*01 > 2'_IGHJ6*01 | 1777 | gnl|Fabrus|L12_IGKJ1*01 | 1088 |
| 2441 VH3-23_IGHD1-20*01 > 3'_IGHJ6*01 | 1778 | gnl|Fabrus|L12_IGKJ1*01 | 1088 |
| 2442 VH3-23_IGHD1-26*01 > 1'_IGHJ6*01 | 1779 | gnl|Fabrus|L12_IGKJ1*01 | 1088 |
| 2443 VH3-23_IGHD1-26*01 > 1_IGHJ6*01_B | 1780 | gnl|Fabrus|L12_IGKJ1*01 | 1088 |
| 2444 VH3-23_IGHD2-2*01 > 2_IGHJ6*01_B | 1781 | gnl|Fabrus|L12_IGKJ1*01 | 1088 |
| 2445 VH3-23_IGHD2-2*01 > 3'_IGHJ6*01 | 1782 | gnl|Fabrus|L12_IGKJ1*01 | 1088 |
| 2446 VH3-23_IGHD2-8*01 > 1'_IGHJ6*01 | 1783 | gnl|Fabrus|L12_IGKJ1*01 | 1088 |
| 2447 VH3-23_IGHD2-15*01 > 1'_IGHJ6*01 | 1784 | gnl|Fabrus|L12_IGKJ1*01 | 1088 |
| 2448 VH3-23_IGHD2-15*01 > 3'_IGHJ6*01 | 1785 | gnl|Fabrus|L12_IGKJ1*01 | 1088 |
| 2449 VH3-23_IGHD2-21*01 > 1'_IGHJ6*01 | 1786 | gnl|Fabrus|L12_IGKJ1*01 | 1088 |
| 2450 VH3-23_IGHD2-21*01 > 3'_IGHJ6*01 | 1787 | gnl|Fabrus|L12_IGKJ1*01 | 1088 |
| 2451 VH3-23_IGHD3-3*01 > 1'_IGHJ6*01 | 1788 | gnl|Fabrus|L12_IGKJ1*01 | 1088 |
| 2452 VH3-23_IGHD3-3*01 > 3'_IGHJ6*01 | 1789 | gnl|Fabrus|L12_IGKJ1*01 | 1088 |
| 2453 VH3-23_IGHD3-9*01 > 1'_IGHJ6*01 | 1790 | gnl|Fabrus|L12_IGKJ1*01 | 1088 |
| 2454 VH3-23_IGHD3-9*01 > 3'_IGHJ6*01 | 1791 | gnl|Fabrus|L12_IGKJ1*01 | 1088 |
| 2455 VH3-23_IGHD3-10*01 > 1'_IGHJ6*01 | 1792 | gnl|Fabrus|L12_IGKJ1*01 | 1088 |
| 2456 VH3-23_IGHD3-10*01 > 3'_IGHJ6*01 | 1793 | gnl|Fabrus|L12_IGKJ1*01 | 1088 |
| 2457 VH3-23_IGHD3-16*01 > 1'_IGHJ6*01 | 1794 | gnl|Fabrus|L12_IGKJ1*01 | 1088 |
| 2458 VH3-23_IGHD3-16*01 > 3'_IGHJ6*01 | 1795 | gnl|Fabrus|L12_IGKJ1*01 | 1088 |
| 2459 VH3-23_IGHD3-22*01 > 1'_IGHJ6*01 | 1796 | gnl|Fabrus|L12_IGKJ1*01 | 1088 |

TABLE 4-continued

Exemplary Paired Nucleic Acid Library

| HEAVY CHAIN | SEQ ID NO | LIGHT CHAIN | SEQ ID NO |
|---|---|---|---|
| 2460 VH3-23_IGHD4-4*01 (1) > 1'_IGHJ6*01 | 1797 | gnl\|Fabrus\|L12_IGKJ1*01 | 1088 |
| 2461 VH3-23_IGHD4-4*01 (1) > 3'_IGHJ6*01 | 1798 | gnl\|Fabrus\|L12_IGKJ1*01 | 1088 |
| 2462 VH3-23_IGHD4-11*01 (1) > 1'_IGHJ6*01 | 1799 | gnl\|Fabrus\|L12_IGKJ1*01 | 1088 |
| 2463 VH3-23_IGHD4-11*01 (1) > 3'_IGHJ6*01 | 1800 | gnl\|Fabrus\|L12_IGKJ1*01 | 1088 |
| 2464 VH3-23_IGHD4-17*01 > 1'_IGHJ6*01 | 1801 | gnl\|Fabrus\|L12_IGKJ1*01 | 1088 |
| 2465 VH3-23_IGHD4-17*01 > 3'_IGHJ6*01 | 1802 | gnl\|Fabrus\|L12_IGKJ1*01 | 1088 |
| 2466 VH3-23_IGHD4-23*01 > 1'_IGHJ6*01 | 1803 | gnl\|Fabrus\|L12_IGKJ1*01 | 1088 |
| 2467 VH3-23_IGHD4-23*01 > 3'_IGHJ6*01 | 1804 | gnl\|Fabrus\|L12_IGKJ1*01 | 1088 |
| 2468 VH3-23_IGHD5-5*01 (2) > 1'_IGHJ6*01 | 1805 | gnl\|Fabrus\|L12_IGKJ1*01 | 1088 |
| 2469 VH3-23_IGHD5-5*01 (2) > 3'_IGHJ6*01 | 1806 | gnl\|Fabrus\|L12_IGKJ1*01 | 1088 |
| 2470 VH3-23_IGHD5-12*01 > 1'_IGHJ6*01 | 1807 | gnl\|Fabrus\|L12_IGKJ1*01 | 1088 |
| 2471 VH3-23_IGHD5-12*01 > 3'_IGHJ6*01 | 1808 | gnl\|Fabrus\|L12_IGKJ1*01 | 1088 |
| 2472 VH3-23_IGHD5-18*01 (2) > 1'_IGHJ6*01 | 1809 | gnl\|Fabrus\|L12_IGKJ1*01 | 1088 |
| 2473 VH3-23_IGHD5-18*01 (2) > 3'_IGHJ6*01 | 1810 | gnl\|Fabrus\|L12_IGKJ1*01 | 1088 |
| 2474 VH3-23_IGHD5-24*01 > 1'_IGHJ6*01 | 1811 | gnl\|Fabrus\|L12_IGKJ1*01 | 1088 |
| 2475 VH3-23_IGHD5-24*01 > 3'_IGHJ6*01 | 1812 | gnl\|Fabrus\|L12_IGKJ1*01 | 1088 |
| 2476 VH3-23_IGHD6-6*01 > 1'_IGHJ6*01 | 1813 | gnl\|Fabrus\|L12_IGKJ1*01 | 1088 |
| 2477 VH3-23_IGHD6-6*01 > 2'_IGHJ6*01 | 1814 | gnl\|Fabrus\|L12_IGKJ1*01 | 1088 |
| 2478 VH3-23_IGHD6-6*01 > 3'_IGHJ6*01 | 1815 | gnl\|Fabrus\|L12_IGKJ1*01 | 1088 |
| 2479 VH3-23_IGHD1-1*01 > 1_IGHJ6*01 | 1711 | gnl\|Fabrus\|O1_IGKJ1*01 | 1100 |
| 2480 VH3-23_IGHD1-1*01 > 2_IGHJ6*01 | 1712 | gnl\|Fabrus\|O1_IGKJ1*01 | 1100 |
| 2481 VH3-23_IGHD1-1*01 > 3_IGHJ6*01 | 1713 | gnl\|Fabrus\|O1_IGKJ1*01 | 1100 |
| 2482 VH3-23_IGHD1-7*01 > 1_IGHJ6*01 | 1714 | gnl\|Fabrus\|O1_IGKJ1*01 | 1100 |
| 2483 VH3-23_IGHD1-7*01 > 3_IGHJ6*01 | 1715 | gnl\|Fabrus\|O1_IGKJ1*01 | 1100 |
| 2484 VH3-23_IGHD1-14*01 > 1_IGHJ6*01 | 1716 | gnl\|Fabrus\|O1_IGKJ1*01 | 1100 |
| 2485 VH3-23_IGHD1-14*01 > 3_IGHJ6*01 | 1717 | gnl\|Fabrus\|O1_IGKJ1*01 | 1100 |
| 2486 VH3-23_IGHD1-20*01 > 1_IGHJ6*01 | 1718 | gnl\|Fabrus\|O1_IGKJ1*01 | 1100 |
| 2487 VH3-23_IGHD1-20*01 > 3_IGHJ6*01 | 1719 | gnl\|Fabrus\|O1_IGKJ1*01 | 1100 |
| 2488 VH3-23_IGHD1-26*01 > 1_IGHJ6*01 | 1720 | gnl\|Fabrus\|O1_IGKJ1*01 | 1100 |
| 2489 VH3-23_IGHD1-26*01 > 3_IGHJ6*01 | 1721 | gnl\|Fabrus\|O1_IGKJ1*01 | 1100 |
| 2490 VH3-23_IGHD2-2*01 > 2_IGHJ6*01 | 1722 | gnl\|Fabrus\|O1_IGKJ1*01 | 1100 |
| 2491 VH3-23_IGHD2-2*01 > 3_IGHJ6*01 | 1723 | gnl\|Fabrus\|O1_IGKJ1*01 | 1100 |
| 2492 VH3-23_IGHD2-8*01 > 2_IGHJ6*01 | 1724 | gnl\|Fabrus\|O1_IGKJ1*01 | 1100 |
| 2493 VH3-23_IGHD2-8*01 > 3_IGHJ6*01 | 1725 | gnl\|Fabrus\|O1_IGKJ1*01 | 1100 |
| 2494 VH3-23_IGHD2-15*01 > 2_IGHJ6*01 | 1726 | gnl\|Fabrus\|O1_IGKJ1*01 | 1100 |
| 2495 VH3-23_IGHD2-15*01 > 3_IGHJ6*01 | 1727 | gnl\|Fabrus\|O1_IGKJ1*01 | 1100 |
| 2496 VH3-23_IGHD2-21*01 > 2_IGHJ6*01 | 1728 | gnl\|Fabrus\|O1_IGKJ1*01 | 1100 |
| 2497 VH3-23_IGHD2-21*01 > 3_IGHJ6*01 | 1729 | gnl\|Fabrus\|O1_IGKJ1*01 | 1100 |
| 2498 VH3-23_IGHD3-3*01 > 1_IGHJ6*01 | 1730 | gnl\|Fabrus\|O1_IGKJ1*01 | 1100 |
| 2499 VH3-23_IGHD3-3*01 > 2_IGHJ6*01 | 1731 | gnl\|Fabrus\|O1_IGKJ1*01 | 1100 |
| 2500 VH3-23_IGHD3-3*01 > 3_IGHJ6*01 | 1732 | gnl\|Fabrus\|O1_IGKJ1*01 | 1100 |
| 2501 VH3-23_IGHD3-9*01 > 2_IGHJ6*01 | 1733 | gnl\|Fabrus\|O1_IGKJ1*01 | 1100 |
| 2502 VH3-23_IGHD3-10*01 > 2_IGHJ6*01 | 1734 | gnl\|Fabrus\|O1_IGKJ1*01 | 1100 |
| 2503 VH3-23_IGHD3-10*01 > 3_IGHJ6*01 | 1735 | gnl\|Fabrus\|O1_IGKJ1*01 | 1100 |
| 2504 VH3-23_IGHD3-16*01 > 2_IGHJ6*01 | 1736 | gnl\|Fabrus\|O1_IGKJ1*01 | 1100 |
| 2505 VH3-23_IGHD3-16*01 > 3_IGHJ6*01 | 1737 | gnl\|Fabrus\|O1_IGKJ1*01 | 1100 |
| 2506 VH3-23_IGHD3-22*01 > 2_IGHJ6*01 | 1738 | gnl\|Fabrus\|O1_IGKJ1*01 | 1100 |
| 2507 VH3-23_IGHD3-22*01 > 3_IGHJ6*01 | 1739 | gnl\|Fabrus\|O1_IGKJ1*01 | 1100 |
| 2508 VH3-23_IGHD4-4*01 (1) > 2_IGHJ6*01 | 1740 | gnl\|Fabrus\|O1_IGKJ1*01 | 1100 |
| 2509 VH3-23_IGHD4-4*01 (1) > 3_IGHJ6*01 | 1741 | gnl\|Fabrus\|O1_IGKJ1*01 | 1100 |
| 2510 VH3-23_IGHD4-11*01 (1) > 2_IGHJ6*01 | 1742 | gnl\|Fabrus\|O1_IGKJ1*01 | 1100 |
| 2511 VH3-23_IGHD4-11*01 (1) > 3_IGHJ6*01 | 1743 | gnl\|Fabrus\|O1_IGKJ1*01 | 1100 |
| 2512 VH3-23_IGHD4-17*01 > 2_IGHJ6*01 | 1744 | gnl\|Fabrus\|O1_IGKJ1*01 | 1100 |
| 2513 VH3-23_IGHD4-17*01 > 3_IGHJ6*01 | 1745 | gnl\|Fabrus\|O1_IGKJ1*01 | 1100 |
| 2514 VH3-23_IGHD4-23*01 > 2_IGHJ6*01 | 1746 | gnl\|Fabrus\|O1_IGKJ1*01 | 1100 |
| 2515 VH3-23_IGHD4-23*01 > 3_IGHJ6*01 | 1747 | gnl\|Fabrus\|O1_IGKJ1*01 | 1100 |
| 2516 VH3-23_IGHD5-5*01 (2) > 1_IGHJ6*01 | 1748 | gnl\|Fabrus\|O1_IGKJ1*01 | 1100 |
| 2517 VH3-23_IGHD5-5*01 (2) > 2_IGHJ6*01 | 1749 | gnl\|Fabrus\|O1_IGKJ1*01 | 1100 |
| 2518 VH3-23_IGHD5-5*01 (2) > 3_IGHJ6*01 | 1750 | gnl\|Fabrus\|O1_IGKJ1*01 | 1100 |
| 2519 VH3-23_IGHD5-12*01 > 1_IGHJ6*01 | 1751 | gnl\|Fabrus\|O1_IGKJ1*01 | 1100 |
| 2520 VH3-23_IGHD5-12*01 > 3_IGHJ6*01 | 1752 | gnl\|Fabrus\|O1_IGKJ1*01 | 1100 |
| 2521 VH3-23_IGHD5-18*01 (2) > 1_IGHJ6*01 | 1753 | gnl\|Fabrus\|O1_IGKJ1*01 | 1100 |
| 2522 VH3-23_IGHD5-18*01 (2) > 2_IGHJ6*01 | 1754 | gnl\|Fabrus\|O1_IGKJ1*01 | 1100 |
| 2523 VH3-23_IGHD5-18*01 (2) > 3_IGHJ6*01 | 1755 | gnl\|Fabrus\|O1_IGKJ1*01 | 1100 |
| 2524 VH3-23_IGHD5-24*01 > 1_IGHJ6*01 | 1756 | gnl\|Fabrus\|O1_IGKJ1*01 | 1100 |
| 2525 VH3-23_IGHD5-24*01 > 3_IGHJ6*01 | 1757 | gnl\|Fabrus\|O1_IGKJ1*01 | 1100 |
| 2526 VH3-23_IGHD6-6*01 > 1_IGHJ6*01 | 1758 | gnl\|Fabrus\|O1_IGKJ1*01 | 1100 |
| 2527 VH3-23_IGHD1-1*01 > 1'_IGHJ6*01 | 1768 | gnl\|Fabrus\|O1_IGKJ1*01 | 1100 |
| 2528 VH3-23_IGHD1-1*01 > 2'_IGHJ6*01 | 1769 | gnl\|Fabrus\|O1_IGKJ1*01 | 1100 |
| 2529 VH3-23_IGHD1-1*01 > 3'_IGHJ6*01 | 1770 | gnl\|Fabrus\|O1_IGKJ1*01 | 1100 |
| 2530 VH3-23_IGHD1-7*01 > 1'_IGHJ6*01 | 1771 | gnl\|Fabrus\|O1_IGKJ1*01 | 1100 |
| 2531 VH3-23_IGHD1-7*01 > 3'_IGHJ6*01 | 1772 | gnl\|Fabrus\|O1_IGKJ1*01 | 1100 |
| 2532 VH3-23_IGHD1-14*01 > 1'_IGHJ6*01 | 1773 | gnl\|Fabrus\|O1_IGKJ1*01 | 1100 |
| 2533 VH3-23_IGHD1-14*01 > 2'_IGHJ6*01 | 1774 | gnl\|Fabrus\|O1_IGKJ1*01 | 1100 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2534 | VH3-23_IGHD1-14*01 > 3'_IGHJ6*01 | 1775 | gnl|Fabrus|O1_IGKJ1*01 | 1100 |
| 2535 | VH3-23_IGHD1-20*01 > 1'_IGHJ6*01 | 1776 | gnl|Fabrus|O1_IGKJ1*01 | 1100 |
| 2536 | VH3-23_IGHD1-20*01 > 2'_IGHJ6*01 | 1777 | gnl|Fabrus|O1_IGKJ1*01 | 1100 |
| 2537 | VH3-23_IGHD1-20*01 > 3'_IGHJ6*01 | 1778 | gnl|Fabrus|O1_IGKJ1*01 | 1100 |
| 2538 | VH3-23_IGHD1-26*01 > 1'_IGHJ6*01 | 1779 | gnl|Fabrus|O1_IGKJ1*01 | 1100 |
| 2539 | VH3-23_IGHD1-26*01 > 1_IGHJ6*01_B | 1780 | gnl|Fabrus|O1_IGKJ1*01 | 1100 |
| 2540 | VH3-23_IGHD2-2*01 > 2_IGHJ6*01_B | 1781 | gnl|Fabrus|O1_IGKJ1*01 | 1100 |
| 2541 | VH3-23_IGHD2-2*01 > 3'_IGHJ6*01 | 1782 | gnl|Fabrus|O1_IGKJ1*01 | 1100 |
| 2542 | VH3-23_IGHD2-8*01 > 1'_IGHJ6*01 | 1783 | gnl|Fabrus|O1_IGKJ1*01 | 1100 |
| 2543 | VH3-23_IGHD2-15*01 > 1'_IGHJ6*01 | 1784 | gnl|Fabrus|O1_IGKJ1*01 | 1100 |
| 2544 | VH3-23_IGHD2-15*01 > 3'_IGHJ6*01 | 1785 | gnl|Fabrus|O1_IGKJ1*01 | 1100 |
| 2545 | VH3-23_IGHD2-21*01 > 1'_IGHJ6*01 | 1786 | gnl|Fabrus|O1_IGKJ1*01 | 1100 |
| 2546 | VH3-23_IGHD2-21*01 > 3'_IGHJ6*01 | 1787 | gnl|Fabrus|O1_IGKJ1*01 | 1100 |
| 2547 | VH3-23_IGHD3-3*01 > 1'_IGHJ6*01 | 1788 | gnl|Fabrus|O1_IGKJ1*01 | 1100 |
| 2548 | VH3-23_IGHD3-3*01 > 3'_IGHJ6*01 | 1789 | gnl|Fabrus|O1_IGKJ1*01 | 1100 |
| 2549 | VH3-23_IGHD3-9*01 > 1'_IGHJ6*01 | 1790 | gnl|Fabrus|O1_IGKJ1*01 | 1100 |
| 2550 | VH3-23_IGHD3-9*01 > 3'_IGHJ6*01 | 1791 | gnl|Fabrus|O1_IGKJ1*01 | 1100 |
| 2551 | VH3-23_IGHD3-10*01 > 1'_IGHJ6*01 | 1792 | gnl|Fabrus|O1_IGKJ1*01 | 1100 |
| 2552 | VH3-23_IGHD3-10*01 > 3'_IGHJ6*01 | 1793 | gnl|Fabrus|O1_IGKJ1*01 | 1100 |
| 2553 | VH3-23_IGHD3-16*01 > 1'_IGHJ6*01 | 1794 | gnl|Fabrus|O1_IGKJ1*01 | 1100 |
| 2554 | VH3-23_IGHD3-16*01 > 3'_IGHJ6*01 | 1795 | gnl|Fabrus|O1_IGKJ1*01 | 1100 |
| 2555 | VH3-23_IGHD3-22*01 > 1'_IGHJ6*01 | 1796 | gnl|Fabrus|O1_IGKJ1*01 | 1100 |
| 2556 | VH3-23_IGHD4-4*01 (1) > 1'_IGHJ6*01 | 1797 | gnl|Fabrus|O1_IGKJ1*01 | 1100 |
| 2557 | VH3-23_IGHD4-4*01 (1) > 3'_IGHJ6*01 | 1798 | gnl|Fabrus|O1_IGKJ1*01 | 1100 |
| 2558 | VH3-23_IGHD4-11*01 (1) > 1'_IGHJ6*01 | 1799 | gnl|Fabrus|O1_IGKJ1*01 | 1100 |
| 2559 | VH3-23_IGHD4-11*01 (1) > 3'_IGHJ6*01 | 1800 | gnl|Fabrus|O1_IGKJ1*01 | 1100 |
| 2560 | VH3-23_IGHD4-17*01 > 1'_IGHJ6*01 | 1801 | gnl|Fabrus|O1_IGKJ1*01 | 1100 |
| 2561 | VH3-23_IGHD4-17*01 > 3'_IGHJ6*01 | 1802 | gnl|Fabrus|O1_IGKJ1*01 | 1100 |
| 2562 | VH3-23_IGHD4-23*01 > 1'_IGHJ6*01 | 1803 | gnl|Fabrus|O1_IGKJ1*01 | 1100 |
| 2563 | VH3-23_IGHD4-23*01 > 3'_IGHJ6*01 | 1804 | gnl|Fabrus|O1_IGKJ1*01 | 1100 |
| 2564 | VH3-23_IGHD5-5*01 (2) > 1'_IGHJ6*01 | 1805 | gnl|Fabrus|O1_IGKJ1*01 | 1100 |
| 2565 | VH3-23_IGHD5-5*01 (2) > 3'_IGHJ6*01 | 1806 | gnl|Fabrus|O1_IGKJ1*01 | 1100 |
| 2566 | VH3-23_IGHD5-12*01 > 1'_IGHJ6*01 | 1807 | gnl|Fabrus|O1_IGKJ1*01 | 1100 |
| 2567 | VH3-23_IGHD5-12*01 > 3'_IGHJ6*01 | 1808 | gnl|Fabrus|O1_IGKJ1*01 | 1100 |
| 2568 | VH3-23_IGHD5-18*01 (2) > 1'_IGHJ6*01 | 1809 | gnl|Fabrus|O1_IGKJ1*01 | 1100 |
| 2569 | VH3-23_IGHD5-18*01 (2) > 3'_IGHJ6*01 | 1810 | gnl|Fabrus|O1_IGKJ1*01 | 1100 |
| 2570 | VH3-23_IGHD5-24*01 > 1'_IGHJ6*01 | 1811 | gnl|Fabrus|O1_IGKJ1*01 | 1100 |
| 2571 | VH3-23_IGHD5-24*01 > 3'_IGHJ6*01 | 1812 | gnl|Fabrus|O1_IGKJ1*01 | 1100 |
| 2572 | VH3-23_IGHD6-6*01 > 1'_IGHJ6*01 | 1813 | gnl|Fabrus|O1_IGKJ1*01 | 1100 |
| 2573 | VH3-23_IGHD6-6*01 > 2'_IGHJ6*01 | 1814 | gnl|Fabrus|O1_IGKJ1*01 | 1100 |
| 2574 | VH3-23_IGHD6-6*01 > 3'_IGHJ6*01 | 1815 | gnl|Fabrus|O1_IGKJ1*01 | 1100 |
| 2575 | VH3-23_IGHD1-1*01 > 1_IGHJ5*01 | 1596 | gnl|Fabrus|A2_IGKJ1*01 | 1076 |
| 2576 | VH3-23_IGHD1-1*01 > 2_IGHJ5*01 | 1597 | gnl|Fabrus|A2_IGKJ1*01 | 1076 |
| 2577 | VH3-23_IGHD1-1*01 > 3_IGHJ5*01 | 1598 | gnl|Fabrus|A2_IGKJ1*01 | 1076 |
| 2578 | VH3-23_IGHD1-7*01 > 1_IGHJ5*01 | 1599 | gnl|Fabrus|A2_IGKJ1*01 | 1076 |
| 2579 | VH3-23_IGHD1-7*01 > 3_IGHJ5*01 | 1600 | gnl|Fabrus|A2_IGKJ1*01 | 1076 |
| 2580 | VH3-23_IGHD1-14*01 > 1_IGHJ5*01 | 1601 | gnl|Fabrus|A2_IGKJ1*01 | 1076 |
| 2581 | VH3-23_IGHD1-14*01 > 3_IGHJ5*01 | 1602 | gnl|Fabrus|A2_IGKJ1*01 | 1076 |
| 2582 | VH3-23_IGHD1-20*01 > 1_IGHJ5*01 | 1603 | gnl|Fabrus|A2_IGKJ1*01 | 1076 |
| 2583 | VH3-23_IGHD1-20*01 > 3_IGHJ5*01 | 1604 | gnl|Fabrus|A2_IGKJ1*01 | 1076 |
| 2584 | VH3-23_IGHD1-26*01 > 1_IGHJ5*01 | 1605 | gnl|Fabrus|A2_IGKJ1*01 | 1076 |
| 2585 | VH3-23_IGHD1-26*01 > 3_IGHJ5*01 | 1606 | gnl|Fabrus|A2_IGKJ1*01 | 1076 |
| 2586 | VH3-23_IGHD2-2*01 > 2_IGHJ5*01 | 1607 | gnl|Fabrus|A2_IGKJ1*01 | 1076 |
| 2587 | VH3-23_IGHD2-2*01 > 3_IGHJ5*01 | 1608 | gnl|Fabrus|A2_IGKJ1*01 | 1076 |
| 2588 | VH3-23_IGHD2-8*01 > 2_IGHJ5*01 | 1609 | gnl|Fabrus|A2_IGKJ1*01 | 1076 |
| 2589 | VH3-23_IGHD2-8*01 > 3_IGHJ5*01 | 1610 | gnl|Fabrus|A2_IGKJ1*01 | 1076 |
| 2590 | VH3-23_IGHD2-15*01 > 2_IGHJ5*01 | 1611 | gnl|Fabrus|A2_IGKJ1*01 | 1076 |
| 2591 | VH3-23_IGHD2-15*01 > 3_IGHJ5*01 | 1612 | gnl|Fabrus|A2_IGKJ1*01 | 1076 |
| 2592 | VH3-23_IGHD2-21*01 > 2_IGHJ5*01 | 1613 | gnl|Fabrus|A2_IGKJ1*01 | 1076 |
| 2593 | VH3-23_IGHD2-21*01 > 3_IGHJ5*01 | 1614 | gnl|Fabrus|A2_IGKJ1*01 | 1076 |
| 2594 | VH3-23_IGHD3-3*01 > 1_IGHJ5*01 | 1615 | gnl|Fabrus|A2_IGKJ1*01 | 1076 |
| 2595 | VH3-23_IGHD3-3*01 > 2_IGHJ5*01 | 1616 | gnl|Fabrus|A2_IGKJ1*01 | 1076 |
| 2596 | VH3-23_IGHD3-3*01 > 3_IGHJ5*01 | 1617 | gnl|Fabrus|A2_IGKJ1*01 | 1076 |
| 2597 | VH3-23_IGHD3-9*01 > 2_IGHJ5*01 | 1618 | gnl|Fabrus|A2_IGKJ1*01 | 1076 |
| 2598 | VH3-23_IGHD3-10*01 > 2_IGHJ5*01 | 1619 | gnl|Fabrus|A2_IGKJ1*01 | 1076 |
| 2599 | VH3-23_IGHD3-10*01 > 3_IGHJ5*01 | 1620 | gnl|Fabrus|A2_IGKJ1*01 | 1076 |
| 2600 | VH3-23_IGHD3-16*01 > 2_IGHJ5*01 | 1621 | gnl|Fabrus|A2_IGKJ1*01 | 1076 |
| 2601 | VH3-23_IGHD3-16*01 > 3_IGHJ5*01 | 1622 | gnl|Fabrus|A2_IGKJ1*01 | 1076 |
| 2602 | VH3-23_IGHD3-22*01 > 2_IGHJ5*01 | 1623 | gnl|Fabrus|A2_IGKJ1*01 | 1076 |
| 2603 | VH3-23_IGHD3-22*01 > 3_IGHJ5*01 | 1624 | gnl|Fabrus|A2_IGKJ1*01 | 1076 |
| 2604 | VH3-23_IGHD4-4*01 (1) > 2_IGHJ5*01 | 1625 | gnl|Fabrus|A2_IGKJ1*01 | 1076 |
| 2605 | VH3-23_IGHD4-4*01 (1) > 3_IGHJ5*01 | 1626 | gnl|Fabrus|A2_IGKJ1*01 | 1076 |
| 2606 | VH3-23_IGHD4-11*01 (1) > 2_IGHJ5*01 | 1627 | gnl|Fabrus|A2_IGKJ1*01 | 1076 |
| 2607 | VH3-23_IGHD4-11*01 (1) > 3_IGHJ5*01 | 1628 | gnl|Fabrus|A2_IGKJ1*01 | 1076 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2608 | VH3-23_IGHD4-17*01 > 2_IGHJ5*01 | 1629 | gnl|Fabrus|A2_IGKJ1*01 | 1076 |
| 2609 | VH3-23_IGHD4-17*01 > 3_IGHJ5*01 | 1630 | gnl|Fabrus|A2_IGKJ1*01 | 1076 |
| 2610 | VH3-23_IGHD4-23*01 > 2_IGHJ5*01 | 1631 | gnl|Fabrus|A2_IGKJ1*01 | 1076 |
| 2611 | VH3-23_IGHD4-23*01 > 3_IGHJ5*01 | 1632 | gnl|Fabrus|A2_IGKJ1*01 | 1076 |
| 2612 | VH3-23_IGHD5-5*01 (2) > 1_IGHJ5*01 | 1633 | gnl|Fabrus|A2_IGKJ1*01 | 1076 |
| 2613 | VH3-23_IGHD5-5*01 (2) > 2_IGHJ5*01 | 1634 | gnl|Fabrus|A2_IGKJ1*01 | 1076 |
| 2614 | VH3-23_IGHD5-5*01 (2) > 3_IGHJ5*01 | 1635 | gnl|Fabrus|A2_IGKJ1*01 | 1076 |
| 2615 | VH3-23_IGHD5-12*01 > 1_IGHJ5*01 | 1636 | gnl|Fabrus|A2_IGKJ1*01 | 1076 |
| 2616 | VH3-23_IGHD5-12*01 > 3_IGHJ5*01 | 1637 | gnl|Fabrus|A2_IGKJ1*01 | 1076 |
| 2617 | VH3-23_IGHD5-18*01 (2) > 1_IGHJ5*01 | 1638 | gnl|Fabrus|A2_IGKJ1*01 | 1076 |
| 2618 | VH3-23_IGHD5-18*01 (2) > 2_IGHJ5*01 | 1639 | gnl|Fabrus|A2_IGKJ1*01 | 1076 |
| 2619 | VH3-23_IGHD5-18*01 (2) > 3_IGHJ5*01 | 1640 | gnl|Fabrus|A2_IGKJ1*01 | 1076 |
| 2620 | VH3-23_IGHD5-24*01 > 1_IGHJ5*01 | 1641 | gnl|Fabrus|A2_IGKJ1*01 | 1076 |
| 2621 | VH3-23_IGHD5-24*01 > 3_IGHJ5*01 | 1642 | gnl|Fabrus|A2_IGKJ1*01 | 1076 |
| 2622 | VH3-23_IGHD6-6*01 > 1_IGHJ5*01 | 1643 | gnl|Fabrus|A2_IGKJ1*01 | 1076 |
| 2623 | VH3-23_IGHD1-1*01 > 1'_IGHJ5*01 | 1653 | gnl|Fabrus|A2_IGKJ1*01 | 1076 |
| 2624 | VH3-23_IGHD1-1*01 > 2'_IGHJ5*01 | 1654 | gnl|Fabrus|A2_IGKJ1*01 | 1076 |
| 2625 | VH3-23_IGHD1-1*01 > 3'_IGHJ5*01 | 1655 | gnl|Fabrus|A2_IGKJ1*01 | 1076 |
| 2626 | VH3-23_IGHD1-7*01 > 1'_IGHJ5*01 | 1656 | gnl|Fabrus|A2_IGKJ1*01 | 1076 |
| 2627 | VH3-23_IGHD1-7*01 > 3'_IGHJ5*01 | 1657 | gnl|Fabrus|A2_IGKJ1*01 | 1076 |
| 2628 | VH3-23_IGHD1-14*01 > 1'_IGHJ5*01 | 1658 | gnl|Fabrus|A2_IGKJ1*01 | 1076 |
| 2629 | VH3-23_IGHD1-14*01 > 2'_IGHJ5*01 | 1659 | gnl|Fabrus|A2_IGKJ1*01 | 1076 |
| 2630 | VH3-23_IGHD1-14*01 > 3'_IGHJ5*01 | 1660 | gnl|Fabrus|A2_IGKJ1*01 | 1076 |
| 2631 | VH3-23_IGHD1-20*01 > 1'_IGHJ5*01 | 1661 | gnl|Fabrus|A2_IGKJ1*01 | 1076 |
| 2632 | VH3-23_IGHD1-20*01 > 2'_IGHJ5*01 | 1662 | gnl|Fabrus|A2_IGKJ1*01 | 1076 |
| 2633 | VH3-23_IGHD1-20*01 > 3'_IGHJ5*01 | 1663 | gnl|Fabrus|A2_IGKJ1*01 | 1076 |
| 2634 | VH3-23_IGHD1-26*01 > 1'_IGHJ5*01 | 1664 | gnl|Fabrus|A2_IGKJ1*01 | 1076 |
| 2635 | VH3-23_IGHD1-26*01 > 3'_IGHJ5*01 | 1665 | gnl|Fabrus|A2_IGKJ1*01 | 1076 |
| 2636 | VH3-23_IGHD2-2*01 > 1'_IGHJ5*01 | 1666 | gnl|Fabrus|A2_IGKJ1*01 | 1076 |
| 2637 | VH3-23_IGHD2-2*01 > 3'_IGHJ5*01 | 1667 | gnl|Fabrus|A2_IGKJ1*01 | 1076 |
| 2638 | VH3-23_IGHD2-8*01 > 1'_IGHJ5*01 | 1668 | gnl|Fabrus|A2_IGKJ1*01 | 1076 |
| 2639 | VH3-23_IGHD2-15*01 > 1'_IGHJ5*01 | 1669 | gnl|Fabrus|A2_IGKJ1*01 | 1076 |
| 2640 | VH3-23_IGHD2-15*01 > 3'_IGHJ5*01 | 1670 | gnl|Fabrus|A2_IGKJ1*01 | 1076 |
| 2641 | VH3-23_IGHD2-21*01 > 1'_IGHJ5*01 | 1671 | gnl|Fabrus|A2_IGKJ1*01 | 1076 |
| 2642 | VH3-23_IGHD2-21*01 > 3'_IGHJ5*01 | 1672 | gnl|Fabrus|A2_IGKJ1*01 | 1076 |
| 2643 | VH3-23_IGHD3-3*01 > 1'_IGHJ5*01 | 1673 | gnl|Fabrus|A2_IGKJ1*01 | 1076 |
| 2644 | VH3-23_IGHD3-3*01 > 3'_IGHJ5*01 | 1674 | gnl|Fabrus|A2_IGKJ1*01 | 1076 |
| 2645 | VH3-23_IGHD3-9*01 > 1'_IGHJ5*01 | 1675 | gnl|Fabrus|A2_IGKJ1*01 | 1076 |
| 2646 | VH3-23_IGHD3-9*01 > 3'_IGHJ5*01 | 1676 | gnl|Fabrus|A2_IGKJ1*01 | 1076 |
| 2647 | VH3-23_IGHD3-10*01 > 1'_IGHJ5*01 | 1677 | gnl|Fabrus|A2_IGKJ1*01 | 1076 |
| 2648 | VH3-23_IGHD3-10*01 > 3'_IGHJ5*01 | 1678 | gnl|Fabrus|A2_IGKJ1*01 | 1076 |
| 2649 | VH3-23_IGHD3-16*01 > 1'_IGHJ5*01 | 1679 | gnl|Fabrus|A2_IGKJ1*01 | 1076 |
| 2650 | VH3-23_IGHD3-16*01 > 3'_IGHJ5*01 | 1680 | gnl|Fabrus|A2_IGKJ1*01 | 1076 |
| 2651 | VH3-23_IGHD3-22*01 > 1'_IGHJ5*01 | 1681 | gnl|Fabrus|A2_IGKJ1*01 | 1076 |
| 2652 | VH3-23_IGHD4-4*01 (1) > 1'_IGHJ5*01 | 1682 | gnl|Fabrus|A2_IGKJ1*01 | 1076 |
| 2653 | VH3-23_IGHD4-4*01 (1) > 3'_IGHJ5*01 | 1683 | gnl|Fabrus|A2_IGKJ1*01 | 1076 |
| 2654 | VH3-23_IGHD4-11*01 (1) > 1'_IGHJ5*01 | 1684 | gnl|Fabrus|A2_IGKJ1*01 | 1076 |
| 2655 | VH3-23_IGHD4-11*01 (1) > 3'_IGHJ5*01 | 1685 | gnl|Fabrus|A2_IGKJ1*01 | 1076 |
| 2656 | VH3-23_IGHD4-17*01 > 1'_IGHJ5*01 | 1686 | gnl|Fabrus|A2_IGKJ1*01 | 1076 |
| 2657 | VH3-23_IGHD4-17*01 > 3'_IGHJ5*01 | 1687 | gnl|Fabrus|A2_IGKJ1*01 | 1076 |
| 2658 | VH3-23_IGHD4-23*01 > 1'_IGHJ5*01 | 1688 | gnl|Fabrus|A2_IGKJ1*01 | 1076 |
| 2659 | VH3-23_IGHD4-23*01 > 3'_IGHJ5*01 | 1689 | gnl|Fabrus|A2_IGKJ1*01 | 1076 |
| 2660 | VH3-23_IGHD5-5*01 (2) > 1'_IGHJ5*01 | 1690 | gnl|Fabrus|A2_IGKJ1*01 | 1076 |
| 2661 | VH3-23_IGHD5-5*01 (2) > 3'_IGHJ5*01 | 1691 | gnl|Fabrus|A2_IGKJ1*01 | 1076 |
| 2662 | VH3-23_IGHD5-12*01 > 1'_IGHJ5*01 | 1692 | gnl|Fabrus|A2_IGKJ1*01 | 1076 |
| 2663 | VH3-23_IGHD5-12*01 > 3'_IGHJ5*01 | 1693 | gnl|Fabrus|A2_IGKJ1*01 | 1076 |
| 2664 | VH3-23_IGHD5-18*01 (2) > 1'_IGHJ5*01 | 1694 | gnl|Fabrus|A2_IGKJ1*01 | 1076 |
| 2665 | VH3-23_IGHD5-18*01 (2) > 3'_IGHJ5*01 | 1695 | gnl|Fabrus|A2_IGKJ1*01 | 1076 |
| 2666 | VH3-23_IGHD5-24*01 > 1'_IGHJ5*01 | 1696 | gnl|Fabrus|A2_IGKJ1*01 | 1076 |
| 2667 | VH3-23_IGHD5-24*01 > 3'_IGHJ5*01 | 1697 | gnl|Fabrus|A2_IGKJ1*01 | 1076 |
| 2668 | VH3-23_IGHD6-6*01 > 1'_IGHJ5*01 | 1698 | gnl|Fabrus|A2_IGKJ1*01 | 1076 |
| 2669 | VH3-23_IGHD6-6*01 > 2'_IGHJ5*01 | 1699 | gnl|Fabrus|A2_IGKJ1*01 | 1076 |
| 2670 | VH3-23_IGHD6-6*01 > 3'_IGHJ5*01 | 1700 | gnl|Fabrus|A2_IGKJ1*01 | 1076 |
| 2671 | VH3-23_IGHD1-1*01 > 1_IGHJ6*01 | 1711 | gnl|Fabrus|L2_IGKJ1*01 | 1090 |
| 2672 | VH3-23_IGHD1-1*01 > 2_IGHJ6*01 | 1712 | gnl|Fabrus|L2_IGKJ1*01 | 1090 |
| 2673 | VH3-23_IGHD1-1*01 > 3_IGHJ6*01 | 1713 | gnl|Fabrus|L2_IGKJ1*01 | 1090 |
| 2674 | VH3-23_IGHD1-7*01 > 1_IGHJ6*01 | 1714 | gnl|Fabrus|L2_IGKJ1*01 | 1090 |
| 2675 | VH3-23_IGHD1-7*01 > 3_IGHJ6*01 | 1715 | gnl|Fabrus|L2_IGKJ1*01 | 1090 |
| 2676 | VH3-23_IGHD1-14*01 > 1_IGHJ6*01 | 1716 | gnl|Fabrus|L2_IGKJ1*01 | 1090 |
| 2677 | VH3-23_IGHD1-14*01 > 3_IGHJ6*01 | 1717 | gnl|Fabrus|L2_IGKJ1*01 | 1090 |
| 2678 | VH3-23_IGHD1-20*01 > 1_IGHJ6*01 | 1718 | gnl|Fabrus|L2_IGKJ1*01 | 1090 |
| 2679 | VH3-23_IGHD1-20*01 > 3_IGHJ6*01 | 1719 | gnl|Fabrus|L2_IGKJ1*01 | 1090 |
| 2680 | VH3-23_IGHD1-26*01 > 1_IGHJ6*01 | 1720 | gnl|Fabrus|L2_IGKJ1*01 | 1090 |
| 2681 | VH3-23_IGHD1-26*01 > 3_IGHJ6*01 | 1721 | gnl|Fabrus|L2_IGKJ1*01 | 1090 |

TABLE 4-continued

Exemplary Paired Nucleic Acid Library

| HEAVY CHAIN | SEQ ID NO | LIGHT CHAIN | SEQ ID NO |
|---|---|---|---|
| 2682 VH3-23_IGHD2-2*01 > 2_IGHJ6*01 | 1722 | gnl\|Fabrus\|L2_IGKJ1*01 | 1090 |
| 2683 VH3-23_IGHD2-2*01 > 3_IGHJ6*01 | 1723 | gnl\|Fabrus\|L2_IGKJ1*01 | 1090 |
| 2684 VH3-23_IGHD2-8*01 > 2_IGHJ6*01 | 1724 | gnl\|Fabrus\|L2_IGKJ1*01 | 1090 |
| 2685 VH3-23_IGHD2-8*01 > 3_IGHJ6*01 | 1725 | gnl\|Fabrus\|L2_IGKJ1*01 | 1090 |
| 2686 VH3-23_IGHD2-15*01 > 2_IGHJ6*01 | 1726 | gnl\|Fabrus\|L2_IGKJ1*01 | 1090 |
| 2687 VH3-23_IGHD2-15*01 > 3_IGHJ6*01 | 1727 | gnl\|Fabrus\|L2_IGKJ1*01 | 1090 |
| 2688 VH3-23_IGHD2-21*01 > 2_IGHJ6*01 | 1728 | gnl\|Fabrus\|L2_IGKJ1*01 | 1090 |
| 2689 VH3-23_IGHD2-21*01 > 3_IGHJ6*01 | 1729 | gnl\|Fabrus\|L2_IGKJ1*01 | 1090 |
| 2690 VH3-23_IGHD3-3*01 > 1_IGHJ6*01 | 1730 | gnl\|Fabrus\|L2_IGKJ1*01 | 1090 |
| 2691 VH3-23_IGHD3-3*01 > 2_IGHJ6*01 | 1731 | gnl\|Fabrus\|L2_IGKJ1*01 | 1090 |
| 2692 VH3-23_IGHD3-3*01 > 3_IGHJ6*01 | 1732 | gnl\|Fabrus\|L2_IGKJ1*01 | 1090 |
| 2693 VH3-23_IGHD3-9*01 > 2_IGHJ6*01 | 1733 | gnl\|Fabrus\|L2_IGKJ1*01 | 1090 |
| 2694 VH3-23_IGHD3-10*01 > 2_IGHJ6*01 | 1734 | gnl\|Fabrus\|L2_IGKJ1*01 | 1090 |
| 2695 VH3-23_IGHD3-10*01 > 3_IGHJ6*01 | 1735 | gnl\|Fabrus\|L2_IGKJ1*01 | 1090 |
| 2696 VH3-23_IGHD3-16*01 > 2_IGHJ6*01 | 1736 | gnl\|Fabrus\|L2_IGKJ1*01 | 1090 |
| 2697 VH3-23_IGHD3-16*01 > 3_IGHJ6*01 | 1737 | gnl\|Fabrus\|L2_IGKJ1*01 | 1090 |
| 2698 VH3-23_IGHD3-22*01 > 2_IGHJ6*01 | 1738 | gnl\|Fabrus\|L2_IGKJ1*01 | 1090 |
| 2699 VH3-23_IGHD3-22*01 > 3_IGHJ6*01 | 1739 | gnl\|Fabrus\|L2_IGKJ1*01 | 1090 |
| 2700 VH3-23_IGHD4-4*01 (1) > 2_IGHJ6*01 | 1740 | gnl\|Fabrus\|L2_IGKJ1*01 | 1090 |
| 2701 VH3-23_IGHD4-4*01 (1) > 3_IGHJ6*01 | 1741 | gnl\|Fabrus\|L2_IGKJ1*01 | 1090 |
| 2702 VH3-23_IGHD4-11*01 (1) > 2_IGHJ6*01 | 1742 | gnl\|Fabrus\|L2_IGKJ1*01 | 1090 |
| 2703 VH3-23_IGHD4-11*01 (1) > 3_IGHJ6*01 | 1743 | gnl\|Fabrus\|L2_IGKJ1*01 | 1090 |
| 2704 VH3-23_IGHD4-17*01 > 2_IGHJ6*01 | 1744 | gnl\|Fabrus\|L2_IGKJ1*01 | 1090 |
| 2705 VH3-23_IGHD4-17*01 > 3_IGHJ6*01 | 1745 | gnl\|Fabrus\|L2_IGKJ1*01 | 1090 |
| 2706 VH3-23_IGHD4-23*01 > 2_IGHJ6*01 | 1746 | gnl\|Fabrus\|L2_IGKJ1*01 | 1090 |
| 2707 VH3-23_IGHD4-23*01 > 3_IGHJ6*01 | 1747 | gnl\|Fabrus\|L2_IGKJ1*01 | 1090 |
| 2708 VH3-23_IGHD5-5*01 (2) > 1_IGHJ6*01 | 1748 | gnl\|Fabrus\|L2_IGKJ1*01 | 1090 |
| 2709 VH3-23_IGHD5-5*01 (2) > 2_IGHJ6*01 | 1749 | gnl\|Fabrus\|L2_IGKJ1*01 | 1090 |
| 2710 VH3-23_IGHD5-5*01 (2) > 3_IGHJ6*01 | 1750 | gnl\|Fabrus\|L2_IGKJ1*01 | 1090 |
| 2711 VH3-23_IGHD5-12*01 > 1_IGHJ6*01 | 1751 | gnl\|Fabrus\|L2_IGKJ1*01 | 1090 |
| 2712 VH3-23_IGHD5-12*01 > 3_IGHJ6*01 | 1752 | gnl\|Fabrus\|L2_IGKJ1*01 | 1090 |
| 2713 VH3-23_IGHD5-18*01 (2) > 1_IGHJ6*01 | 1753 | gnl\|Fabrus\|L2_IGKJ1*01 | 1090 |
| 2714 VH3-23_IGHD5-18*01 (2) > 2_IGHJ6*01 | 1754 | gnl\|Fabrus\|L2_IGKJ1*01 | 1090 |
| 2715 VH3-23_IGHD5-18*01 (2) > 3_IGHJ6*01 | 1755 | gnl\|Fabrus\|L2_IGKJ1*01 | 1090 |
| 2716 VH3-23_IGHD5-24*01 > 1_IGHJ6*01 | 1756 | gnl\|Fabrus\|L2_IGKJ1*01 | 1090 |
| 2717 VH3-23_IGHD5-24*01 > 3_IGHJ6*01 | 1757 | gnl\|Fabrus\|L2_IGKJ1*01 | 1090 |
| 2718 VH3-23_IGHD6-6*01 > 1_IGHJ6*01 | 1758 | gnl\|Fabrus\|L2_IGKJ1*01 | 1090 |
| 2719 VH3-23_IGHD1-1*01 > 1'_IGHJ6*01 | 1768 | gnl\|Fabrus\|L2_IGKJ1*01 | 1090 |
| 2720 VH3-23_IGHD1-1*01 > 2'_IGHJ6*01 | 1769 | gnl\|Fabrus\|L2_IGKJ1*01 | 1090 |
| 2721 VH3-23_IGHD1-1*01 > 3'_IGHJ6*01 | 1770 | gnl\|Fabrus\|L2_IGKJ1*01 | 1090 |
| 2722 VH3-23_IGHD1-7*01 > 1'_IGHJ6*01 | 1771 | gnl\|Fabrus\|L2_IGKJ1*01 | 1090 |
| 2723 VH3-23_IGHD1-7*01 > 3'_IGHJ6*01 | 1772 | gnl\|Fabrus\|L2_IGKJ1*01 | 1090 |
| 2724 VH3-23_IGHD1-14*01 > 1'_IGHJ6*01 | 1773 | gnl\|Fabrus\|L2_IGKJ1*01 | 1090 |
| 2725 VH3-23_IGHD1-14*01 > 2'_IGHJ6*01 | 1774 | gnl\|Fabrus\|L2_IGKJ1*01 | 1090 |
| 2726 VH3-23_IGHD1-14*01 > 3'_IGHJ6*01 | 1775 | gnl\|Fabrus\|L2_IGKJ1*01 | 1090 |
| 2727 VH3-23_IGHD1-20*01 > 1'_IGHJ6*01 | 1776 | gnl\|Fabrus\|L2_IGKJ1*01 | 1090 |
| 2728 VH3-23_IGHD1-20*01 > 2'_IGHJ6*01 | 1777 | gnl\|Fabrus\|L2_IGKJ1*01 | 1090 |
| 2729 VH3-23_IGHD1-20*01 > 3'_IGHJ6*01 | 1778 | gnl\|Fabrus\|L2_IGKJ1*01 | 1090 |
| 2730 VH3-23_IGHD1-26*01 > 1'_IGHJ6*01 | 1779 | gnl\|Fabrus\|L2_IGKJ1*01 | 1090 |
| 2731 VH3-23_IGHD1-26*01 > 1_IGHJ6*01_B | 1780 | gnl\|Fabrus\|L2_IGKJ1*01 | 1090 |
| 2732 VH3-23_IGHD2-2*01 > 2_IGHJ6*01_B | 1781 | gnl\|Fabrus\|L2_IGKJ1*01 | 1090 |
| 2733 VH3-23_IGHD2-2*01 > 3'_IGHJ6*01 | 1782 | gnl\|Fabrus\|L2_IGKJ1*01 | 1090 |
| 2734 VH3-23_IGHD2-8*01 > 1'_IGHJ6*01 | 1783 | gnl\|Fabrus\|L2_IGKJ1*01 | 1090 |
| 2735 VH3-23_IGHD2-15*01 > 1'_IGHJ6*01 | 1784 | gnl\|Fabrus\|L2_IGKJ1*01 | 1090 |
| 2736 VH3-23_IGHD2-15*01 > 3'_IGHJ6*01 | 1785 | gnl\|Fabrus\|L2_IGKJ1*01 | 1090 |
| 2737 VH3-23_IGHD2-21*01 > 1'_IGHJ6*01 | 1786 | gnl\|Fabrus\|L2_IGKJ1*01 | 1090 |
| 2738 VH3-23_IGHD2-21*01 > 3'_IGHJ6*01 | 1787 | gnl\|Fabrus\|L2_IGKJ1*01 | 1090 |
| 2739 VH3-23_IGHD3-3*01 > 1'_IGHJ6*01 | 1788 | gnl\|Fabrus\|L2_IGKJ1*01 | 1090 |
| 2740 VH3-23_IGHD3-3*01 > 3'_IGHJ6*01 | 1789 | gnl\|Fabrus\|L2_IGKJ1*01 | 1090 |
| 2741 VH3-23_IGHD3-9*01 > 1'_IGHJ6*01 | 1790 | gnl\|Fabrus\|L2_IGKJ1*01 | 1090 |
| 2742 VH3-23_IGHD3-9*01 > 3'_IGHJ6*01 | 1791 | gnl\|Fabrus\|L2_IGKJ1*01 | 1090 |
| 2743 VH3-23_IGHD3-10*01 > 1'_IGHJ6*01 | 1792 | gnl\|Fabrus\|L2_IGKJ1*01 | 1090 |
| 2744 VH3-23_IGHD3-10*01 > 3'_IGHJ6*01 | 1793 | gnl\|Fabrus\|L2_IGKJ1*01 | 1090 |
| 2745 VH3-23_IGHD3-16*01 > 1'_IGHJ6*01 | 1794 | gnl\|Fabrus\|L2_IGKJ1*01 | 1090 |
| 2746 VH3-23_IGHD3-16*01 > 3'_IGHJ6*01 | 1795 | gnl\|Fabrus\|L2_IGKJ1*01 | 1090 |
| 2747 VH3-23_IGHD3-22*01 > 1'_IGHJ6*01 | 1796 | gnl\|Fabrus\|L2_IGKJ1*01 | 1090 |
| 2748 VH3-23_IGHD4-4*01 (1) > 1'_IGHJ6*01 | 1797 | gnl\|Fabrus\|L2_IGKJ1*01 | 1090 |
| 2749 VH3-23_IGHD4-4*01 (1) > 3'_IGHJ6*01 | 1798 | gnl\|Fabrus\|L2_IGKJ1*01 | 1090 |
| 2750 VH3-23_IGHD4-11*01 (1) > 1'_IGHJ6*01 | 1799 | gnl\|Fabrus\|L2_IGKJ1*01 | 1090 |
| 2751 VH3-23_IGHD4-11*01 (1) > 3'_IGHJ6*01 | 1800 | gnl\|Fabrus\|L2_IGKJ1*01 | 1090 |
| 2752 VH3-23_IGHD4-17*01 > 1'_IGHJ6*01 | 1801 | gnl\|Fabrus\|L2_IGKJ1*01 | 1090 |
| 2753 VH3-23_IGHD4-17*01 > 3'_IGHJ6*01 | 1802 | gnl\|Fabrus\|L2_IGKJ1*01 | 1090 |
| 2754 VH3-23_IGHD4-23*01 > 1'_IGHJ6*01 | 1803 | gnl\|Fabrus\|L2_IGKJ1*01 | 1090 |
| 2755 VH3-23_IGHD4-23*01 > 3'_IGHJ6*01 | 1804 | gnl\|Fabrus\|L2_IGKJ1*01 | 1090 |

TABLE 4-continued

Exemplary Paired Nucleic Acid Library

| HEAVY CHAIN | SEQ ID NO | LIGHT CHAIN | SEQ ID NO |
|---|---|---|---|
| 2756 VH3-23_IGHD5-5*01 (2) > 1'_IGHJ6*01 | 1805 | gnl|Fabrus|L2_IGKJ1*01 | 1090 |
| 2757 VH3-23_IGHD5-5*01 (2) > 3'_IGHJ6*01 | 1806 | gnl|Fabrus|L2_IGKJ1*01 | 1090 |
| 2758 VH3-23_IGHD5-12*01 > 1'_IGHJ6*01 | 1807 | gnl|Fabrus|L2_IGKJ1*01 | 1090 |
| 2759 VH3-23_IGHD5-12*01 > 3'_IGHJ6*01 | 1808 | gnl|Fabrus|L2_IGKJ1*01 | 1090 |
| 2760 VH3-23_IGHD5-18*01 (2) > 1'_IGHJ6*01 | 1809 | gnl|Fabrus|L2_IGKJ1*01 | 1090 |
| 2761 VH3-23_IGHD5-18*01 (2) > 3'_IGHJ6*01 | 1810 | gnl|Fabrus|L2_IGKJ1*01 | 1090 |
| 2762 VH3-23_IGHD5-24*01 > 1'_IGHJ6*01 | 1811 | gnl|Fabrus|L2_IGKJ1*01 | 1090 |
| 2763 VH3-23_IGHD5-24*01 > 3'_IGHJ6*01 | 1812 | gnl|Fabrus|L2_IGKJ1*01 | 1090 |
| 2764 VH3-23_IGHD6-6*01 > 1'_IGHJ6*01 | 1813 | gnl|Fabrus|L2_IGKJ1*01 | 1090 |
| 2765 VH3-23_IGHD6-6*01 > 2'_IGHJ6*01 | 1814 | gnl|Fabrus|L2_IGKJ1*01 | 1090 |
| 2766 VH3-23_IGHD6-6*01 > 3'_IGHJ6*01 | 1815 | gnl|Fabrus|L2_IGKJ1*01 | 1090 |
| 2767 VH3-23_IGHD1-1*01 > 1_IGHJ6*01 | 1711 | gnl|Fabrus|L6_IGKJ1*01 | 1097 |
| 2768 VH3-23_IGHD1-1*01 > 2_IGHJ6*01 | 1712 | gnl|Fabrus|L6_IGKJ1*01 | 1097 |
| 2769 VH3-23_IGHD1-1*01 > 3_IGHJ6*01 | 1713 | gnl|Fabrus|L6_IGKJ1*01 | 1097 |
| 2770 VH3-23_IGHD1-7*01 > 1_IGHJ6*01 | 1714 | gnl|Fabrus|L6_IGKJ1*01 | 1097 |
| 2771 VH3-23_IGHD1-7*01 > 3_IGHJ6*01 | 1715 | gnl|Fabrus|L6_IGKJ1*01 | 1097 |
| 2772 VH3-23_IGHD1-14*01 > 1_IGHJ6*01 | 1716 | gnl|Fabrus|L6_IGKJ1*01 | 1097 |
| 2773 VH3-23_IGHD1-14*01 > 3_IGHJ6*01 | 1717 | gnl|Fabrus|L6_IGKJ1*01 | 1097 |
| 2774 VH3-23_IGHD1-20*01 > 1_IGHJ6*01 | 1718 | gnl|Fabrus|L6_IGKJ1*01 | 1097 |
| 2775 VH3-23_IGHD1-20*01 > 3_IGHJ6*01 | 1719 | gnl|Fabrus|L6_IGKJ1*01 | 1097 |
| 2776 VH3-23_IGHD1-26*01 > 1_IGHJ6*01 | 1720 | gnl|Fabrus|L6_IGKJ1*01 | 1097 |
| 2777 VH3-23_IGHD1-26*01 > 3_IGHJ6*01 | 1721 | gnl|Fabrus|L6_IGKJ1*01 | 1097 |
| 2778 VH3-23_IGHD2-2*01 > 2_IGHJ6*01 | 1722 | gnl|Fabrus|L6_IGKJ1*01 | 1097 |
| 2779 VH3-23_IGHD2-2*01 > 3_IGHJ6*01 | 1723 | gnl|Fabrus|L6_IGKJ1*01 | 1097 |
| 2780 VH3-23_IGHD2-8*01 > 2_IGHJ6*01 | 1724 | gnl|Fabrus|L6_IGKJ1*01 | 1097 |
| 2781 VH3-23_IGHD2-8*01 > 3_IGHJ6*01 | 1725 | gnl|Fabrus|L6_IGKJ1*01 | 1097 |
| 2782 VH3-23_IGHD2-15*01 > 2_IGHJ6*01 | 1726 | gnl|Fabrus|L6_IGKJ1*01 | 1097 |
| 2783 VH3-23_IGHD2-15*01 > 3_IGHJ6*01 | 1727 | gnl|Fabrus|L6_IGKJ1*01 | 1097 |
| 2784 VH3-23_IGHD2-21*01 > 2_IGHJ6*01 | 1728 | gnl|Fabrus|L6_IGKJ1*01 | 1097 |
| 2785 VH3-23_IGHD2-21*01 > 3_IGHJ6*01 | 1729 | gnl|Fabrus|L6_IGKJ1*01 | 1097 |
| 2786 VH3-23_IGHD3-3*01 > 1_IGHJ6*01 | 1730 | gnl|Fabrus|L6_IGKJ1*01 | 1097 |
| 2787 VH3-23_IGHD3-3*01 > 2_IGHJ6*01 | 1731 | gnl|Fabrus|L6_IGKJ1*01 | 1097 |
| 2788 VH3-23_IGHD3-3*01 > 3_IGHJ6*01 | 1732 | gnl|Fabrus|L6_IGKJ1*01 | 1097 |
| 2789 VH3-23_IGHD3-9*01 > 2_IGHJ6*01 | 1733 | gnl|Fabrus|L6_IGKJ1*01 | 1097 |
| 2790 VH3-23_IGHD3-10*01 > 2_IGHJ6*01 | 1734 | gnl|Fabrus|L6_IGKJ1*01 | 1097 |
| 2791 VH3-23_IGHD3-10*01 > 3_IGHJ6*01 | 1735 | gnl|Fabrus|L6_IGKJ1*01 | 1097 |
| 2792 VH3-23_IGHD3-16*01 > 2_IGHJ6*01 | 1736 | gnl|Fabrus|L6_IGKJ1*01 | 1097 |
| 2793 VH3-23_IGHD3-16*01 > 3_IGHJ6*01 | 1737 | gnl|Fabrus|L6_IGKJ1*01 | 1097 |
| 2794 VH3-23_IGHD3-22*01 > 2_IGHJ6*01 | 1738 | gnl|Fabrus|L6_IGKJ1*01 | 1097 |
| 2795 VH3-23_IGHD3-22*01 > 3_IGHJ6*01 | 1739 | gnl|Fabrus|L6_IGKJ1*01 | 1097 |
| 2796 VH3-23_IGHD4-4*01 (1) > 2_IGHJ6*01 | 1740 | gnl|Fabrus|L6_IGKJ1*01 | 1097 |
| 2797 VH3-23_IGHD4-4*01 (1) > 3_IGHJ6*01 | 1741 | gnl|Fabrus|L6_IGKJ1*01 | 1097 |
| 2798 VH3-23_IGHD4-11*01 (1) > 2_IGHJ6*01 | 1742 | gnl|Fabrus|L6_IGKJ1*01 | 1097 |
| 2799 VH3-23_IGHD4-11*01 (1) > 3_IGHJ6*01 | 1743 | gnl|Fabrus|L6_IGKJ1*01 | 1097 |
| 2800 VH3-23_IGHD4-17*01 > 2_IGHJ6*01 | 1744 | gnl|Fabrus|L6_IGKJ1*01 | 1097 |
| 2801 VH3-23_IGHD4-17*01 > 3_IGHJ6*01 | 1745 | gnl|Fabrus|L6_IGKJ1*01 | 1097 |
| 2802 VH3-23_IGHD4-23*01 > 2_IGHJ6*01 | 1746 | gnl|Fabrus|L6_IGKJ1*01 | 1097 |
| 2803 VH3-23_IGHD4-23*01 > 3_IGHJ6*01 | 1747 | gnl|Fabrus|L6_IGKJ1*01 | 1097 |
| 2804 VH3-23_IGHD5-5*01 (2) > 1_IGHJ6*01 | 1748 | gnl|Fabrus|L6_IGKJ1*01 | 1097 |
| 2805 VH3-23_IGHD5-5*01 (2) > 2_IGHJ6*01 | 1749 | gnl|Fabrus|L6_IGKJ1*01 | 1097 |
| 2806 VH3-23_IGHD5-5*01 (2) > 3_IGHJ6*01 | 1750 | gnl|Fabrus|L6_IGKJ1*01 | 1097 |
| 2807 VH3-23_IGHD5-12*01 > 1_IGHJ6*01 | 1751 | gnl|Fabrus|L6_IGKJ1*01 | 1097 |
| 2808 VH3-23_IGHD5-12*01 > 3_IGHJ6*01 | 1752 | gnl|Fabrus|L6_IGKJ1*01 | 1097 |
| 2809 VH3-23_IGHD5-18*01 (2) > 1_IGHJ6*01 | 1753 | gnl|Fabrus|L6_IGKJ1*01 | 1097 |
| 2810 VH3-23_IGHD5-18*01 (2) > 2_IGHJ6*01 | 1754 | gnl|Fabrus|L6_IGKJ1*01 | 1097 |
| 2811 VH3-23_IGHD5-18*01 (2) > 3_IGHJ6*01 | 1755 | gnl|Fabrus|L6_IGKJ1*01 | 1097 |
| 2812 VH3-23_IGHD5-24*01 > 1_IGHJ6*01 | 1756 | gnl|Fabrus|L6_IGKJ1*01 | 1097 |
| 2813 VH3-23_IGHD5-24*01 > 3_IGHJ6*01 | 1757 | gnl|Fabrus|L6_IGKJ1*01 | 1097 |
| 2814 VH3-23_IGHD6-6*01 > 1_IGHJ6*01 | 1758 | gnl|Fabrus|L6_IGKJ1*01 | 1097 |
| 2815 VH3-23_IGHD1-1*01 > 1'_IGHJ6*01 | 1768 | gnl|Fabrus|L6_IGKJ1*01 | 1097 |
| 2816 VH3-23_IGHD1-1*01 > 2'_IGHJ6*01 | 1769 | gnl|Fabrus|L6_IGKJ1*01 | 1097 |
| 2817 VH3-23_IGHD1-1*01 > 3'_IGHJ6*01 | 1770 | gnl|Fabrus|L6_IGKJ1*01 | 1097 |
| 2818 VH3-23_IGHD1-7*01 > 1'_IGHJ6*01 | 1771 | gnl|Fabrus|L6_IGKJ1*01 | 1097 |
| 2819 VH3-23_IGHD1-7*01 > 3'_IGHJ6*01 | 1772 | gnl|Fabrus|L6_IGKJ1*01 | 1097 |
| 2820 VH3-23_IGHD1-14*01 > 1'_IGHJ6*01 | 1773 | gnl|Fabrus|L6_IGKJ1*01 | 1097 |
| 2821 VH3-23_IGHD1-14*01 > 2'_IGHJ6*01 | 1774 | gnl|Fabrus|L6_IGKJ1*01 | 1097 |
| 2822 VH3-23_IGHD1-14*01 > 3'_IGHJ6*01 | 1775 | gnl|Fabrus|L6_IGKJ1*01 | 1097 |
| 2823 VH3-23_IGHD1-20*01 > 1'_IGHJ6*01 | 1776 | gnl|Fabrus|L6_IGKJ1*01 | 1097 |
| 2824 VH3-23_IGHD1-20*01 > 2'_IGHJ6*01 | 1777 | gnl|Fabrus|L6_IGKJ1*01 | 1097 |
| 2825 VH3-23_IGHD1-20*01 > 3'_IGHJ6*01 | 1778 | gnl|Fabrus|L6_IGKJ1*01 | 1097 |
| 2826 VH3-23_IGHD1-26*01 > 1'_IGHJ6*01 | 1779 | gnl|Fabrus|L6_IGKJ1*01 | 1097 |
| 2827 VH3-23_IGHD1-26*01 > 1_IGHJ6*01_B | 1780 | gnl|Fabrus|L6_IGKJ1*01 | 1097 |
| 2828 VH3-23_IGHD2-2*01 > 2_IGHJ6*01_B | 1781 | gnl|Fabrus|L6_IGKJ1*01 | 1097 |
| 2829 VH3-23_IGHD2-2*01 > 3'_IGHJ6*01 | 1782 | gnl|Fabrus|L6_IGKJ1*01 | 1097 |

TABLE 4-continued

Exemplary Paired Nucleic Acid Library

| HEAVY CHAIN | SEQ ID NO | LIGHT CHAIN | SEQ ID NO |
|---|---|---|---|
| 2830 VH3-23_IGHD2-8*01 > 1'_IGHJ6*01 | 1783 | gnl|Fabrus|L6_IGKJ1*01 | 1097 |
| 2831 VH3-23_IGHD2-15*01 > 1'_IGHJ6*01 | 1784 | gnl|Fabrus|L6_IGKJ1*01 | 1097 |
| 2832 VH3-23_IGHD2-15*01 > 3'_IGHJ6*01 | 1785 | gnl|Fabrus|L6_IGKJ1*01 | 1097 |
| 2833 VH3-23_IGHD2-21*01 > 1'_IGHJ6*01 | 1786 | gnl|Fabrus|L6_IGKJ1*01 | 1097 |
| 2834 VH3-23_IGHD2-21*01 > 3'_IGHJ6*01 | 1787 | gnl|Fabrus|L6_IGKJ1*01 | 1097 |
| 2835 VH3-23_IGHD3-3*01 > 1'_IGHJ6*01 | 1788 | gnl|Fabrus|L6_IGKJ1*01 | 1097 |
| 2836 VH3-23_IGHD3-3*01 > 3'_IGHJ6*01 | 1789 | gnl|Fabrus|L6_IGKJ1*01 | 1097 |
| 2837 VH3-23_IGHD3-9*01 > 1'_IGHJ6*01 | 1790 | gnl|Fabrus|L6_IGKJ1*01 | 1097 |
| 2838 VH3-23_IGHD3-9*01 > 3'_IGHJ6*01 | 1791 | gnl|Fabrus|L6_IGKJ1*01 | 1097 |
| 2839 VH3-23_IGHD3-10*01 > 1'_IGHJ6*01 | 1792 | gnl|Fabrus|L6_IGKJ1*01 | 1097 |
| 2840 VH3-23_IGHD3-10*01 > 3'_IGHJ6*01 | 1793 | gnl|Fabrus|L6_IGKJ1*01 | 1097 |
| 2841 VH3-23_IGHD3-16*01 > 1'_IGHJ6*01 | 1794 | gnl|Fabrus|L6_IGKJ1*01 | 1097 |
| 2842 VH3-23_IGHD3-16*01 > 3'_IGHJ6*01 | 1795 | gnl|Fabrus|L6_IGKJ1*01 | 1097 |
| 2843 VH3-23_IGHD3-22*01 > 1'_IGHJ6*01 | 1796 | gnl|Fabrus|L6_IGKJ1*01 | 1097 |
| 2844 VH3-23_IGHD4-4*01 (1) > 1'_IGHJ6*01 | 1797 | gnl|Fabrus|L6_IGKJ1*01 | 1097 |
| 2845 VH3-23_IGHD4-4*01 (1) > 3'_IGHJ6*01 | 1798 | gnl|Fabrus|L6_IGKJ1*01 | 1097 |
| 2846 VH3-23_IGHD4-11*01 (1) > 1'_IGHJ6*01 | 1799 | gnl|Fabrus|L6_IGKJ1*01 | 1097 |
| 2847 VH3-23_IGHD4-11*01 (1) > 3'_IGHJ6*01 | 1800 | gnl|Fabrus|L6_IGKJ1*01 | 1097 |
| 2848 VH3-23_IGHD4-17*01 > 1'_IGHJ6*01 | 1801 | gnl|Fabrus|L6_IGKJ1*01 | 1097 |
| 2849 VH3-23_IGHD4-17*01 > 3'_IGHJ6*01 | 1802 | gnl|Fabrus|L6_IGKJ1*01 | 1097 |
| 2850 VH3-23_IGHD4-23*01 > 1'_IGHJ6*01 | 1803 | gnl|Fabrus|L6_IGKJ1*01 | 1097 |
| 2851 VH3-23_IGHD4-23*01 > 3'_IGHJ6*01 | 1804 | gnl|Fabrus|L6_IGKJ1*01 | 1097 |
| 2852 VH3-23_IGHD5-5*01 (2) > 1'_IGHJ6*01 | 1805 | gnl|Fabrus|L6_IGKJ1*01 | 1097 |
| 2853 VH3-23_IGHD5-5*01 (2) > 3'_IGHJ6*01 | 1806 | gnl|Fabrus|L6_IGKJ1*01 | 1097 |
| 2854 VH3-23_IGHD5-12*01 > 1'_IGHJ6*01 | 1807 | gnl|Fabrus|L6_IGKJ1*01 | 1097 |
| 2855 VH3-23_IGHD5-12*01 > 3'_IGHJ6*01 | 1808 | gnl|Fabrus|L6_IGKJ1*01 | 1097 |
| 2856 VH3-23_IGHD5-18*01 (2) > 1'_IGHJ6*01 | 1809 | gnl|Fabrus|L6_IGKJ1*01 | 1097 |
| 2857 VH3-23_IGHD5-18*01 (2) > 3'_IGHJ6*01 | 1810 | gnl|Fabrus|L6_IGKJ1*01 | 1097 |
| 2858 VH3-23_IGHD5-24*01 > 1'_IGHJ6*01 | 1811 | gnl|Fabrus|L6_IGKJ1*01 | 1097 |
| 2859 VH3-23_IGHD5-24*01 > 3'_IGHJ6*01 | 1812 | gnl|Fabrus|L6_IGKJ1*01 | 1097 |
| 2860 VH3-23_IGHD6-6*01 > 1'_IGHJ6*01 | 1813 | gnl|Fabrus|L6_IGKJ1*01 | 1097 |
| 2861 VH3-23_IGHD6-6*01 > 2'_IGHJ6*01 | 1814 | gnl|Fabrus|L6_IGKJ1*01 | 1097 |
| 2862 VH3-23_IGHD6-6*01 > 3'_IGHJ6*01 | 1815 | gnl|Fabrus|L6_IGKJ1*01 | 1097 |
| 2863 VH3-23_IGHD1-1*01 > 1_IGHJ5*01 | 1596 | gnl|Fabrus|L25_IGKJ1*01 | 1093 |
| 2864 VH3-23_IGHD1-1*01 > 2_IGHJ5*01 | 1597 | gnl|Fabrus|L25_IGKJ1*01 | 1093 |
| 2865 VH3-23_IGHD1-1*01 > 3_IGHJ5*01 | 1598 | gnl|Fabrus|L25_IGKJ1*01 | 1093 |
| 2866 VH3-23_IGHD1-7*01 > 1_IGHJ5*01 | 1599 | gnl|Fabrus|L25_IGKJ1*01 | 1093 |
| 2867 VH3-23_IGHD1-7*01 > 3_IGHJ5*01 | 1600 | gnl|Fabrus|L25_IGKJ1*01 | 1093 |
| 2868 VH3-23_IGHD1-14*01 > 1_IGHJ5*01 | 1601 | gnl|Fabrus|L25_IGKJ1*01 | 1093 |
| 2869 VH3-23_IGHD1-14*01 > 3_IGHJ5*01 | 1602 | gnl|Fabrus|L25_IGKJ1*01 | 1093 |
| 2870 VH3-23_IGHD1-20*01 > 1_IGHJ5*01 | 1603 | gnl|Fabrus|L25_IGKJ1*01 | 1093 |
| 2871 VH3-23_IGHD1-20*01 > 3_IGHJ5*01 | 1604 | gnl|Fabrus|L25_IGKJ1*01 | 1093 |
| 2872 VH3-23_IGHD1-26*01 > 1_IGHJ5*01 | 1605 | gnl|Fabrus|L25_IGKJ1*01 | 1093 |
| 2873 VH3-23_IGHD1-26*01 > 3_IGHJ5*01 | 1606 | gnl|Fabrus|L25_IGKJ1*01 | 1093 |
| 2874 VH3-23_IGHD2-2*01 > 2_IGHJ5*01 | 1607 | gnl|Fabrus|L25_IGKJ1*01 | 1093 |
| 2875 VH3-23_IGHD2-2*01 > 3_IGHJ5*01 | 1608 | gnl|Fabrus|L25_IGKJ1*01 | 1093 |
| 2876 VH3-23_IGHD2-8*01 > 2_IGHJ5*01 | 1609 | gnl|Fabrus|L25_IGKJ1*01 | 1093 |
| 2877 VH3-23_IGHD2-8*01 > 3_IGHJ5*01 | 1610 | gnl|Fabrus|L25_IGKJ1*01 | 1093 |
| 2878 VH3-23_IGHD2-15*01 > 2_IGHJ5*01 | 1611 | gnl|Fabrus|L25_IGKJ1*01 | 1093 |
| 2879 VH3-23_IGHD2-15*01 > 3_IGHJ5*01 | 1612 | gnl|Fabrus|L25_IGKJ1*01 | 1093 |
| 2880 VH3-23_IGHD2-21*01 > 2_IGHJ5*01 | 1613 | gnl|Fabrus|L25_IGKJ1*01 | 1093 |
| 2881 VH3-23_IGHD2-21*01 > 3_IGHJ5*01 | 1614 | gnl|Fabrus|L25_IGKJ1*01 | 1093 |
| 2882 VH3-23_IGHD3-3*01 > 1_IGHJ5*01 | 1615 | gnl|Fabrus|L25_IGKJ1*01 | 1093 |
| 2883 VH3-23_IGHD3-3*01 > 2_IGHJ5*01 | 1616 | gnl|Fabrus|L25_IGKJ1*01 | 1093 |
| 2884 VH3-23_IGHD3-3*01 > 3_IGHJ5*01 | 1617 | gnl|Fabrus|L25_IGKJ1*01 | 1093 |
| 2885 VH3-23_IGHD3-9*01 > 2_IGHJ5*01 | 1618 | gnl|Fabrus|L25_IGKJ1*01 | 1093 |
| 2886 VH3-23_IGHD3-10*01 > 2_IGHJ5*01 | 1619 | gnl|Fabrus|L25_IGKJ1*01 | 1093 |
| 2887 VH3-23_IGHD3-10*01 > 3_IGHJ5*01 | 1620 | gnl|Fabrus|L25_IGKJ1*01 | 1093 |
| 2888 VH3-23_IGHD3-16*01 > 2_IGHJ5*01 | 1621 | gnl|Fabrus|L25_IGKJ1*01 | 1093 |
| 2889 VH3-23_IGHD3-16*01 > 3_IGHJ5*01 | 1622 | gnl|Fabrus|L25_IGKJ1*01 | 1093 |
| 2890 VH3-23_IGHD3-22*01 > 2_IGHJ5*01 | 1623 | gnl|Fabrus|L25_IGKJ1*01 | 1093 |
| 2891 VH3-23_IGHD3-22*01 > 3_IGHJ5*01 | 1624 | gnl|Fabrus|L25_IGKJ1*01 | 1093 |
| 2892 VH3-23_IGHD4-4*01 (1) > 2_IGHJ5*01 | 1625 | gnl|Fabrus|L25_IGKJ1*01 | 1093 |
| 2893 VH3-23_IGHD4-4*01 (1) > 3_IGHJ5*01 | 1626 | gnl|Fabrus|L25_IGKJ1*01 | 1093 |
| 2894 VH3-23_IGHD4-11*01 (1) > 2_IGHJ5*01 | 1627 | gnl|Fabrus|L25_IGKJ1*01 | 1093 |
| 2895 VH3-23_IGHD4-11*01 (1) > 3_IGHJ5*01 | 1628 | gnl|Fabrus|L25_IGKJ1*01 | 1093 |
| 2896 VH3-23_IGHD4-17*01 > 2_IGHJ5*01 | 1629 | gnl|Fabrus|L25_IGKJ1*01 | 1093 |
| 2897 VH3-23_IGHD4-17*01 > 3_IGHJ5*01 | 1630 | gnl|Fabrus|L25_IGKJ1*01 | 1093 |
| 2898 VH3-23_IGHD4-23*01 > 2_IGHJ5*01 | 1631 | gnl|Fabrus|L25_IGKJ1*01 | 1093 |
| 2899 VH3-23_IGHD4-23*01 > 3_IGHJ5*01 | 1632 | gnl|Fabrus|L25_IGKJ1*01 | 1093 |
| 2900 VH3-23_IGHD5-5*01 (2) > 1_IGHJ5*01 | 1633 | gnl|Fabrus|L25_IGKJ1*01 | 1093 |
| 2901 VH3-23_IGHD5-5*01 (2) > 2_IGHJ5*01 | 1634 | gnl|Fabrus|L25_IGKJ1*01 | 1093 |
| 2902 VH3-23_IGHD5-5*01 (2) > 3_IGHJ5*01 | 1635 | gnl|Fabrus|L25_IGKJ1*01 | 1093 |
| 2903 VH3-23_IGHD5-12*01 > 1_IGHJ5*01 | 1636 | gnl|Fabrus|L25_IGKJ1*01 | 1093 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2904 | VH3-23_IGHD5-12*01 > 3_IGHJ5*01 | 1637 | gnl|Fabrus|L25_IGKJ1*01 | 1093 |
| 2905 | VH3-23_IGHD5-18*01 (2) > 1_IGHJ5*01 | 1638 | gnl|Fabrus|L25_IGKJ1*01 | 1093 |
| 2906 | VH3-23_IGHD5-18*01 (2) > 2_IGHJ5*01 | 1639 | gnl|Fabrus|L25_IGKJ1*01 | 1093 |
| 2907 | VH3-23_IGHD5-18*01 (2) > 3_IGHJ5*01 | 1640 | gnl|Fabrus|L25_IGKJ1*01 | 1093 |
| 2908 | VH3-23_IGHD5-24*01 > 1_IGHJ5*01 | 1641 | gnl|Fabrus|L25_IGKJ1*01 | 1093 |
| 2909 | VH3-23_IGHD5-24*01 > 3_IGHJ5*01 | 1642 | gnl|Fabrus|L25_IGKJ1*01 | 1093 |
| 2910 | VH3-23_IGHD6-6*01 > 1_IGHJ5*01 | 1643 | gnl|Fabrus|L25_IGKJ1*01 | 1093 |
| 2911 | VH3-23_IGHD1-1*01 > 1'_IGHJ5*01 | 1653 | gnl|Fabrus|L25_IGKJ1*01 | 1093 |
| 2912 | VH3-23_IGHD1-1*01 > 2'_IGHJ5*01 | 1654 | gnl|Fabrus|L25_IGKJ1*01 | 1093 |
| 2913 | VH3-23_IGHD1-1*01 > 3'_IGHJ5*01 | 1655 | gnl|Fabrus|L25_IGKJ1*01 | 1093 |
| 2914 | VH3-23_IGHD1-7*01 > 1'_IGHJ5*01 | 1656 | gnl|Fabrus|L25_IGKJ1*01 | 1093 |
| 2915 | VH3-23_IGHD1-7*01 > 3'_IGHJ5*01 | 1657 | gnl|Fabrus|L25_IGKJ1*01 | 1093 |
| 2916 | VH3-23_IGHD1-14*01 > 1'_IGHJ5*01 | 1658 | gnl|Fabrus|L25_IGKJ1*01 | 1093 |
| 2917 | VH3-23_IGHD1-14*01 > 2'_IGHJ5*01 | 1659 | gnl|Fabrus|L25_IGKJ1*01 | 1093 |
| 2918 | VH3-23_IGHD1-14*01 > 3'_IGHJ5*01 | 1660 | gnl|Fabrus|L25_IGKJ1*01 | 1093 |
| 2919 | VH3-23_IGHD1-20*01 > 1'_IGHJ5*01 | 1661 | gnl|Fabrus|L25_IGKJ1*01 | 1093 |
| 2920 | VH3-23_IGHD1-20*01 > 2'_IGHJ5*01 | 1662 | gnl|Fabrus|L25_IGKJ1*01 | 1093 |
| 2921 | VH3-23_IGHD1-20*01 > 3'_IGHJ5*01 | 1663 | gnl|Fabrus|L25_IGKJ1*01 | 1093 |
| 2922 | VH3-23_IGHD1-26*01 > 1'_IGHJ5*01 | 1664 | gnl|Fabrus|L25_IGKJ1*01 | 1093 |
| 2923 | VH3-23_IGHD1-26*01 > 3'_IGHJ5*01 | 1665 | gnl|Fabrus|L25_IGKJ1*01 | 1093 |
| 2924 | VH3-23_IGHD2-2*01 > 1'_IGHJ5*01 | 1666 | gnl|Fabrus|L25_IGKJ1*01 | 1093 |
| 2925 | VH3-23_IGHD2-2*01 > 3'_IGHJ5*01 | 1667 | gnl|Fabrus|L25_IGKJ1*01 | 1093 |
| 2926 | VH3-23_IGHD2-8*01 > 1'_IGHJ5*01 | 1668 | gnl|Fabrus|L25_IGKJ1*01 | 1093 |
| 2927 | VH3-23_IGHD2-15*01 > 1'_IGHJ5*01 | 1669 | gnl|Fabrus|L25_IGKJ1*01 | 1093 |
| 2928 | VH3-23_IGHD2-15*01 > 3'_IGHJ5*01 | 1670 | gnl|Fabrus|L25_IGKJ1*01 | 1093 |
| 2929 | VH3-23_IGHD2-21*01 > 1'_IGHJ5*01 | 1671 | gnl|Fabrus|L25_IGKJ1*01 | 1093 |
| 2930 | VH3-23_IGHD2-21*01 > 3'_IGHJ5*01 | 1672 | gnl|Fabrus|L25_IGKJ1*01 | 1093 |
| 2931 | VH3-23_IGHD3-3*01 > 1'_IGHJ5*01 | 1673 | gnl|Fabrus|L25_IGKJ1*01 | 1093 |
| 2932 | VH3-23_IGHD3-3*01 > 3'_IGHJ5*01 | 1674 | gnl|Fabrus|L25_IGKJ1*01 | 1093 |
| 2933 | VH3-23_IGHD3-9*01 > 1'_IGHJ5*01 | 1675 | gnl|Fabrus|L25_IGKJ1*01 | 1093 |
| 2934 | VH3-23_IGHD3-9*01 > 3'_IGHJ5*01 | 1676 | gnl|Fabrus|L25_IGKJ1*01 | 1093 |
| 2935 | VH3-23_IGHD3-10*01 > 1'_IGHJ5*01 | 1677 | gnl|Fabrus|L25_IGKJ1*01 | 1093 |
| 2936 | VH3-23_IGHD3-10*01 > 3'_IGHJ5*01 | 1678 | gnl|Fabrus|L25_IGKJ1*01 | 1093 |
| 2937 | VH3-23_IGHD3-16*01 > 1'_IGHJ5*01 | 1679 | gnl|Fabrus|L25_IGKJ1*01 | 1093 |
| 2938 | VH3-23_IGHD3-16*01 > 3'_IGHJ5*01 | 1680 | gnl|Fabrus|L25_IGKJ1*01 | 1093 |
| 2939 | VH3-23_IGHD3-22*01 > 1'_IGHJ5*01 | 1681 | gnl|Fabrus|L25_IGKJ1*01 | 1093 |
| 2940 | VH3-23_IGHD4-4*01 (1) > 1'_IGHJ5*01 | 1682 | gnl|Fabrus|L25_IGKJ1*01 | 1093 |
| 2941 | VH3-23_IGHD4-4*01 (1) > 3'_IGHJ5*01 | 1683 | gnl|Fabrus|L25_IGKJ1*01 | 1093 |
| 2942 | VH3-23_IGHD4-11*01 (1) > 1'_IGHJ5*01 | 1684 | gnl|Fabrus|L25_IGKJ1*01 | 1093 |
| 2943 | VH3-23_IGHD4-11*01 (1) > 3'_IGHJ5*01 | 1685 | gnl|Fabrus|L25_IGKJ1*01 | 1093 |
| 2944 | VH3-23_IGHD4-17*01 > 1'_IGHJ5*01 | 1686 | gnl|Fabrus|L25_IGKJ1*01 | 1093 |
| 2945 | VH3-23_IGHD4-17*01 > 3'_IGHJ5*01 | 1687 | gnl|Fabrus|L25_IGKJ1*01 | 1093 |
| 2946 | VH3-23_IGHD4-23*01 > 1'_IGHJ5*01 | 1688 | gnl|Fabrus|L25_IGKJ1*01 | 1093 |
| 2947 | VH3-23_IGHD4-23*01 > 3'_IGHJ5*01 | 1689 | gnl|Fabrus|L25_IGKJ1*01 | 1093 |
| 2948 | VH3-23_IGHD5-5*01 (2) > 1'_IGHJ5*01 | 1690 | gnl|Fabrus|L25_IGKJ1*01 | 1093 |
| 2949 | VH3-23_IGHD5-5*01 (2) > 3'_IGHJ5*01 | 1691 | gnl|Fabrus|L25_IGKJ1*01 | 1093 |
| 2950 | VH3-23_IGHD5-12*01 > 1'_IGHJ5*01 | 1692 | gnl|Fabrus|L25_IGKJ1*01 | 1093 |
| 2951 | VH3-23_IGHD5-12*01 > 3'_IGHJ5*01 | 1693 | gnl|Fabrus|L25_IGKJ1*01 | 1093 |
| 2952 | VH3-23_IGHD5-18*01 (2) > 1'_IGHJ5*01 | 1694 | gnl|Fabrus|L25_IGKJ1*01 | 1093 |
| 2953 | VH3-23_IGHD5-18*01 (2) > 3'_IGHJ5*01 | 1695 | gnl|Fabrus|L25_IGKJ1*01 | 1093 |
| 2954 | VH3-23_IGHD5-24*01 > 1'_IGHJ5*01 | 1696 | gnl|Fabrus|L25_IGKJ1*01 | 1093 |
| 2955 | VH3-23_IGHD5-24*01 > 3'_IGHJ5*01 | 1697 | gnl|Fabrus|L25_IGKJ1*01 | 1093 |
| 2956 | VH3-23_IGHD6-6*01 > 1'_IGHJ5*01 | 1698 | gnl|Fabrus|L25_IGKJ1*01 | 1093 |
| 2957 | VH3-23_IGHD6-6*01 > 2'_IGHJ5*01 | 1699 | gnl|Fabrus|L25_IGKJ1*01 | 1093 |
| 2958 | VH3-23_IGHD6-6*01 > 3'_IGHJ5*01 | 1700 | gnl|Fabrus|L25_IGKJ1*01 | 1093 |
| 2959 | VH3-23_IGHD1-1*01 > 1_IGHJ5*01 | 1596 | gnl|Fabrus|B3_IGKJ1*01 | 1085 |
| 2960 | VH3-23_IGHD1-1*01 > 2_IGHJ5*01 | 1597 | gnl|Fabrus|B3_IGKJ1*01 | 1085 |
| 2961 | VH3-23_IGHD1-1*01 > 3_IGHJ5*01 | 1598 | gnl|Fabrus|B3_IGKJ1*01 | 1085 |
| 2962 | VH3-23_IGHD1-7*01 > 1_IGHJ5*01 | 1599 | gnl|Fabrus|B3_IGKJ1*01 | 1085 |
| 2963 | VH3-23_IGHD1-7*01 > 3_IGHJ5*01 | 1600 | gnl|Fabrus|B3_IGKJ1*01 | 1085 |
| 2964 | VH3-23_IGHD1-14*01 > 1_IGHJ5*01 | 1601 | gnl|Fabrus|B3_IGKJ1*01 | 1085 |
| 2965 | VH3-23_IGHD1-14*01 > 3_IGHJ5*01 | 1602 | gnl|Fabrus|B3_IGKJ1*01 | 1085 |
| 2966 | VH3-23_IGHD1-20*01 > 1_IGHJ5*01 | 1603 | gnl|Fabrus|B3_IGKJ1*01 | 1085 |
| 2967 | VH3-23_IGHD1-20*01 > 3_IGHJ5*01 | 1604 | gnl|Fabrus|B3_IGKJ1*01 | 1085 |
| 2968 | VH3-23_IGHD1-26*01 > 1_IGHJ5*01 | 1605 | gnl|Fabrus|B3_IGKJ1*01 | 1085 |
| 2969 | VH3-23_IGHD1-26*01 > 3_IGHJ5*01 | 1606 | gnl|Fabrus|B3_IGKJ1*01 | 1085 |
| 2970 | VH3-23_IGHD2-2*01 > 2_IGHJ5*01 | 1607 | gnl|Fabrus|B3_IGKJ1*01 | 1085 |
| 2971 | VH3-23_IGHD2-2*01 > 3_IGHJ5*01 | 1608 | gnl|Fabrus|B3_IGKJ1*01 | 1085 |
| 2972 | VH3-23_IGHD2-8*01 > 2_IGHJ5*01 | 1609 | gnl|Fabrus|B3_IGKJ1*01 | 1085 |
| 2973 | VH3-23_IGHD2-8*01 > 3_IGHJ5*01 | 1610 | gnl|Fabrus|B3_IGKJ1*01 | 1085 |
| 2974 | VH3-23_IGHD2-15*01 > 2_IGHJ5*01 | 1611 | gnl|Fabrus|B3_IGKJ1*01 | 1085 |
| 2975 | VH3-23_IGHD2-15*01 > 3_IGHJ5*01 | 1612 | gnl|Fabrus|B3_IGKJ1*01 | 1085 |
| 2976 | VH3-23_IGHD2-21*01 > 2_IGHJ5*01 | 1613 | gnl|Fabrus|B3_IGKJ1*01 | 1085 |
| 2977 | VH3-23_IGHD2-21*01 > 3_IGHJ5*01 | 1614 | gnl|Fabrus|B3_IGKJ1*01 | 1085 |

TABLE 4-continued

Exemplary Paired Nucleic Acid Library

| | HEAVY CHAIN | SEQ ID NO | LIGHT CHAIN | SEQ ID NO |
|---|---|---|---|---|
| 2978 | VH3-23_IGHD3-3*01 > 1_IGHJ5*01 | 1615 | gnl|Fabrus|B3_IGKJ1*01 | 1085 |
| 2979 | VH3-23_IGHD3-3*01 > 2_IGHJ5*01 | 1616 | gnl|Fabrus|B3_IGKJ1*01 | 1085 |
| 2980 | VH3-23_IGHD3-3*01 > 3_IGHJ5*01 | 1617 | gnl|Fabrus|B3_IGKJ1*01 | 1085 |
| 2981 | VH3-23_IGHD3-9*01 > 2_IGHJ5*01 | 1618 | gnl|Fabrus|B3_IGKJ1*01 | 1085 |
| 2982 | VH3-23_IGHD3-10*01 > 2_IGHJ5*01 | 1619 | gnl|Fabrus|B3_IGKJ1*01 | 1085 |
| 2983 | VH3-23_IGHD3-10*01 > 3_IGHJ5*01 | 1620 | gnl|Fabrus|B3_IGKJ1*01 | 1085 |
| 2984 | VH3-23_IGHD3-16*01 > 2_IGHJ5*01 | 1621 | gnl|Fabrus|B3_IGKJ1*01 | 1085 |
| 2985 | VH3-23_IGHD3-16*01 > 3_IGHJ5*01 | 1622 | gnl|Fabrus|B3_IGKJ1*01 | 1085 |
| 2986 | VH3-23_IGHD3-22*01 > 2_IGHJ5*01 | 1623 | gnl|Fabrus|B3_IGKJ1*01 | 1085 |
| 2987 | VH3-23_IGHD3-22*01 > 3_IGHJ5*01 | 1624 | gnl|Fabrus|B3_IGKJ1*01 | 1085 |
| 2988 | VH3-23_IGHD4-4*01 (1) > 2_IGHJ5*01 | 1625 | gnl|Fabrus|B3_IGKJ1*01 | 1085 |
| 2989 | VH3-23_IGHD4-4*01 (1) > 3_IGHJ5*01 | 1626 | gnl|Fabrus|B3_IGKJ1*01 | 1085 |
| 2990 | VH3-23_IGHD4-11*01 (1) > 2_IGHJ5*01 | 1627 | gnl|Fabrus|B3_IGKJ1*01 | 1085 |
| 2991 | VH3-23_IGHD4-11*01 (1) > 3_IGHJ5*01 | 1628 | gnl|Fabrus|B3_IGKJ1*01 | 1085 |
| 2992 | VH3-23_IGHD4-17*01 > 2_IGHJ5*01 | 1629 | gnl|Fabrus|B3_IGKJ1*01 | 1085 |
| 2993 | VH3-23_IGHD4-17*01 > 3_IGHJ5*01 | 1630 | gnl|Fabrus|B3_IGKJ1*01 | 1085 |
| 2994 | VH3-23_IGHD4-23*01 > 2_IGHJ5*01 | 1631 | gnl|Fabrus|B3_IGKJ1*01 | 1085 |
| 2995 | VH3-23_IGHD4-23*01 > 3_IGHJ5*01 | 1632 | gnl|Fabrus|B3_IGKJ1*01 | 1085 |
| 2996 | VH3-23_IGHD5-5*01 (2) > 1_IGHJ5*01 | 1633 | gnl|Fabrus|B3_IGKJ1*01 | 1085 |
| 2997 | VH3-23_IGHD5-5*01 (2) > 2_IGHJ5*01 | 1634 | gnl|Fabrus|B3_IGKJ1*01 | 1085 |
| 2998 | VH3-23_IGHD5-5*01 (2) > 3_IGHJ5*01 | 1635 | gnl|Fabrus|B3_IGKJ1*01 | 1085 |
| 2999 | VH3-23_IGHD5-12*01 > 1_IGHJ5*01 | 1636 | gnl|Fabrus|B3_IGKJ1*01 | 1085 |
| 3000 | VH3-23_IGHD5-12*01 > 3_IGHJ5*01 | 1637 | gnl|Fabrus|B3_IGKJ1*01 | 1085 |
| 3001 | VH3-23_IGHD5-18*01 (2) > 1_IGHJ5*01 | 1638 | gnl|Fabrus|B3_IGKJ1*01 | 1085 |
| 3002 | VH3-23_IGHD5-18*01 (2) > 2_IGHJ5*01 | 1639 | gnl|Fabrus|B3_IGKJ1*01 | 1085 |
| 3003 | VH3-23_IGHD5-18*01 (2) > 3_IGHJ5*01 | 1640 | gnl|Fabrus|B3_IGKJ1*01 | 1085 |
| 3004 | VH3-23_IGHD5-24*01 > 1_IGHJ5*01 | 1641 | gnl|Fabrus|B3_IGKJ1*01 | 1085 |
| 3005 | VH3-23_IGHD5-24*01 > 3_IGHJ5*01 | 1642 | gnl|Fabrus|B3_IGKJ1*01 | 1085 |
| 3006 | VH3-23_IGHD6-6*01 > 1_IGHJ5*01 | 1643 | gnl|Fabrus|B3_IGKJ1*01 | 1085 |
| 3007 | VH3-23_IGHD1-1*01 > 1'_IGHJ5*01 | 1653 | gnl|Fabrus|B3_IGKJ1*01 | 1085 |
| 3008 | VH3-23_IGHD1-1*01 > 2'_IGHJ5*01 | 1654 | gnl|Fabrus|B3_IGKJ1*01 | 1085 |
| 3009 | VH3-23_IGHD1-1*01 > 3'_IGHJ5*01 | 1655 | gnl|Fabrus|B3_IGKJ1*01 | 1085 |
| 3010 | VH3-23_IGHD1-7*01 > 1'_IGHJ5*01 | 1656 | gnl|Fabrus|B3_IGKJ1*01 | 1085 |
| 3011 | VH3-23_IGHD1-7*01 > 3'_IGHJ5*01 | 1657 | gnl|Fabrus|B3_IGKJ1*01 | 1085 |
| 3012 | VH3-23_IGHD1-14*01 > 1'_IGHJ5*01 | 1658 | gnl|Fabrus|B3_IGKJ1*01 | 1085 |
| 3013 | VH3-23_IGHD1-14*01 > 2'_IGHJ5*01 | 1659 | gnl|Fabrus|B3_IGKJ1*01 | 1085 |
| 3014 | VH3-23_IGHD1-14*01 > 3'_IGHJ5*01 | 1660 | gnl|Fabrus|B3_IGKJ1*01 | 1085 |
| 3015 | VH3-23_IGHD1-20*01 > 1'_IGHJ5*01 | 1661 | gnl|Fabrus|B3_IGKJ1*01 | 1085 |
| 3016 | VH3-23_IGHD1-20*01 > 2'_IGHJ5*01 | 1662 | gnl|Fabrus|B3_IGKJ1*01 | 1085 |
| 3017 | VH3-23_IGHD1-20*01 > 3'_IGHJ5*01 | 1663 | gnl|Fabrus|B3_IGKJ1*01 | 1085 |
| 3018 | VH3-23_IGHD1-26*01 > 1'_IGHJ5*01 | 1664 | gnl|Fabrus|B3_IGKJ1*01 | 1085 |
| 3019 | VH3-23_IGHD1-26*01 > 3'_IGHJ5*01 | 1665 | gnl|Fabrus|B3_IGKJ1*01 | 1085 |
| 3020 | VH3-23_IGHD2-2*01 > 1'_IGHJ5*01 | 1666 | gnl|Fabrus|B3_IGKJ1*01 | 1085 |
| 3021 | VH3-23_IGHD2-2*01 > 3'_IGHJ5*01 | 1667 | gnl|Fabrus|B3_IGKJ1*01 | 1085 |
| 3022 | VH3-23_IGHD2-8*01 > 1'_IGHJ5*01 | 1668 | gnl|Fabrus|B3_IGKJ1*01 | 1085 |
| 3023 | VH3-23_IGHD2-15*01 > 1'_IGHJ5*01 | 1669 | gnl|Fabrus|B3_IGKJ1*01 | 1085 |
| 3024 | VH3-23_IGHD2-15*01 > 3'_IGHJ5*01 | 1670 | gnl|Fabrus|B3_IGKJ1*01 | 1085 |
| 3025 | VH3-23_IGHD2-21*01 > 1'_IGHJ5*01 | 1671 | gnl|Fabrus|B3_IGKJ1*01 | 1085 |
| 3026 | VH3-23_IGHD2-21*01 > 3'_IGHJ5*01 | 1672 | gnl|Fabrus|B3_IGKJ1*01 | 1085 |
| 3027 | VH3-23_IGHD3-3*01 > 1'_IGHJ5*01 | 1673 | gnl|Fabrus|B3_IGKJ1*01 | 1085 |
| 3028 | VH3-23_IGHD3-3*01 > 3'_IGHJ5*01 | 1674 | gnl|Fabrus|B3_IGKJ1*01 | 1085 |
| 3029 | VH3-23_IGHD3-9*01 > 1'_IGHJ5*01 | 1675 | gnl|Fabrus|B3_IGKJ1*01 | 1085 |
| 3030 | VH3-23_IGHD3-9*01 > 3'_IGHJ5*01 | 1676 | gnl|Fabrus|B3_IGKJ1*01 | 1085 |
| 3031 | VH3-23_IGHD3-10*01 > 1'_IGHJ5*01 | 1677 | gnl|Fabrus|B3_IGKJ1*01 | 1085 |
| 3032 | VH3-23_IGHD3-10*01 > 3'_IGHJ5*01 | 1678 | gnl|Fabrus|B3_IGKJ1*01 | 1085 |
| 3033 | VH3-23_IGHD3-16*01 > 1'_IGHJ5*01 | 1679 | gnl|Fabrus|B3_IGKJ1*01 | 1085 |
| 3034 | VH3-23_IGHD3-16*01 > 3'_IGHJ5*01 | 1680 | gnl|Fabrus|B3_IGKJ1*01 | 1085 |
| 3035 | VH3-23_IGHD3-22*01 > 1'_IGHJ5*01 | 1681 | gnl|Fabrus|B3_IGKJ1*01 | 1085 |
| 3036 | VH3-23_IGHD4-4*01 (1) > 1'_IGHJ5*01 | 1682 | gnl|Fabrus|B3_IGKJ1*01 | 1085 |
| 3037 | VH3-23_IGHD4-4*01 (1) > 3'_IGHJ5*01 | 1683 | gnl|Fabrus|B3_IGKJ1*01 | 1085 |
| 3038 | VH3-23_IGHD4-11*01 (1) > 1'_IGHJ5*01 | 1684 | gnl|Fabrus|B3_IGKJ1*01 | 1085 |
| 3039 | VH3-23_IGHD4-11*01 (1) > 3'_IGHJ5*01 | 1685 | gnl|Fabrus|B3_IGKJ1*01 | 1085 |
| 3040 | VH3-23_IGHD4-17*01 > 1'_IGHJ5*01 | 1686 | gnl|Fabrus|B3_IGKJ1*01 | 1085 |
| 3041 | VH3-23_IGHD4-17*01 > 3'_IGHJ5*01 | 1687 | gnl|Fabrus|B3_IGKJ1*01 | 1085 |
| 3042 | VH3-23_IGHD4-23*01 > 1'_IGHJ5*01 | 1688 | gnl|Fabrus|B3_IGKJ1*01 | 1085 |
| 3043 | VH3-23_IGHD4-23*01 > 3'_IGHJ5*01 | 1689 | gnl|Fabrus|B3_IGKJ1*01 | 1085 |
| 3044 | VH3-23_IGHD5-5*01 (2) > 1'_IGHJ5*01 | 1690 | gnl|Fabrus|B3_IGKJ1*01 | 1085 |
| 3045 | VH3-23_IGHD5-5*01 (2) > 3'_IGHJ5*01 | 1691 | gnl|Fabrus|B3_IGKJ1*01 | 1085 |
| 3046 | VH3-23_IGHD5-12*01 > 1'_IGHJ5*01 | 1692 | gnl|Fabrus|B3_IGKJ1*01 | 1085 |
| 3047 | VH3-23_IGHD5-12*01 > 3'_IGHJ5*01 | 1693 | gnl|Fabrus|B3_IGKJ1*01 | 1085 |
| 3048 | VH3-23_IGHD5-18*01 (2) > 1'_IGHJ5*01 | 1694 | gnl|Fabrus|B3_IGKJ1*01 | 1085 |
| 3049 | VH3-23_IGHD5-18*01 (2) > 3'_IGHJ5*01 | 1695 | gnl|Fabrus|B3_IGKJ1*01 | 1085 |
| 3050 | VH3-23_IGHD5-24*01 > 1'_IGHJ5*01 | 1696 | gnl|Fabrus|B3_IGKJ1*01 | 1085 |
| 3051 | VH3-23_IGHD5-24*01 > 3'_IGHJ5*01 | 1697 | gnl|Fabrus|B3_IGKJ1*01 | 1085 |

TABLE 4-continued

Exemplary Paired Nucleic Acid Library

| HEAVY CHAIN | SEQ ID NO | LIGHT CHAIN | SEQ ID NO |
|---|---|---|---|
| 3052 VH3-23_IGHD6-6*01 > 1'_IGHJ5*01 | 1698 | gnl\|Fabrus\|B3_IGKJ1*01 | 1085 |
| 3053 VH3-23_IGHD6-6*01 > 2'_IGHJ5*01 | 1699 | gnl\|Fabrus\|B3_IGKJ1*01 | 1085 |
| 3054 VH3-23_IGHD6-6*01 > 3'_IGHJ5*01 | 1700 | gnl\|Fabrus\|B3_IGKJ1*01 | 1085 |
| 3055 VH3-23_IGHD1-1*01 > 1_IGHJ5*01 | 1596 | gnl\|Fabrus\|A26_IGKJ1*01 | 1079 |
| 3056 VH3-23_IGHD1-1*01 > 2_IGHJ5*01 | 1597 | gnl\|Fabrus\|A26_IGKJ1*01 | 1079 |
| 3057 VH3-23_IGHD1-1*01 > 3_IGHJ5*01 | 1598 | gnl\|Fabrus\|A26_IGKJ1*01 | 1079 |
| 3058 VH3-23_IGHD1-7*01 > 1_IGHJ5*01 | 1599 | gnl\|Fabrus\|A26_IGKJ1*01 | 1079 |
| 3059 VH3-23_IGHD1-7*01 > 3_IGHJ5*01 | 1600 | gnl\|Fabrus\|A26_IGKJ1*01 | 1079 |
| 3060 VH3-23_IGHD1-14*01 > 1_IGHJ5*01 | 1601 | gnl\|Fabrus\|A26_IGKJ1*01 | 1079 |
| 3061 VH3-23_IGHD1-14*01 > 3_IGHJ5*01 | 1602 | gnl\|Fabrus\|A26_IGKJ1*01 | 1079 |
| 3062 VH3-23_IGHD1-20*01 > 1_IGHJ5*01 | 1603 | gnl\|Fabrus\|A26_IGKJ1*01 | 1079 |
| 3063 VH3-23_IGHD1-20*01 > 3_IGHJ5*01 | 1604 | gnl\|Fabrus\|A26_IGKJ1*01 | 1079 |
| 3064 VH3-23_IGHD1-26*01 > 1_IGHJ5*01 | 1605 | gnl\|Fabrus\|A26_IGKJ1*01 | 1079 |
| 3065 VH3-23_IGHD1-26*01 > 3_IGHJ5*01 | 1606 | gnl\|Fabrus\|A26_IGKJ1*01 | 1079 |
| 3066 VH3-23_IGHD2-2*01 > 2_IGHJ5*01 | 1607 | gnl\|Fabrus\|A26_IGKJ1*01 | 1079 |
| 3067 VH3-23_IGHD2-2*01 > 3_IGHJ5*01 | 1608 | gnl\|Fabrus\|A26_IGKJ1*01 | 1079 |
| 3068 VH3-23_IGHD2-8*01 > 2_IGHJ5*01 | 1609 | gnl\|Fabrus\|A26_IGKJ1*01 | 1079 |
| 3069 VH3-23_IGHD2-8*01 > 3_IGHJ5*01 | 1610 | gnl\|Fabrus\|A26_IGKJ1*01 | 1079 |
| 3070 VH3-23_IGHD2-15*01 > 2_IGHJ5*01 | 1611 | gnl\|Fabrus\|A26_IGKJ1*01 | 1079 |
| 3071 VH3-23_IGHD2-15*01 > 3_IGHJ5*01 | 1612 | gnl\|Fabrus\|A26_IGKJ1*01 | 1079 |
| 3072 VH3-23_IGHD2-21*01 > 2_IGHJ5*01 | 1613 | gnl\|Fabrus\|A26_IGKJ1*01 | 1079 |
| 3073 VH3-23_IGHD2-21*01 > 3_IGHJ5*01 | 1614 | gnl\|Fabrus\|A26_IGKJ1*01 | 1079 |
| 3074 VH3-23_IGHD3-3*01 > 1_IGHJ5*01 | 1615 | gnl\|Fabrus\|A26_IGKJ1*01 | 1079 |
| 3075 VH3-23_IGHD3-3*01 > 2_IGHJ5*01 | 1616 | gnl\|Fabrus\|A26_IGKJ1*01 | 1079 |
| 3076 VH3-23_IGHD3-3*01 > 3_IGHJ5*01 | 1617 | gnl\|Fabrus\|A26_IGKJ1*01 | 1079 |
| 3077 VH3-23_IGHD3-9*01 > 2_IGHJ5*01 | 1618 | gnl\|Fabrus\|A26_IGKJ1*01 | 1079 |
| 3078 VH3-23_IGHD3-10*01 > 2_IGHJ5*01 | 1619 | gnl\|Fabrus\|A26_IGKJ1*01 | 1079 |
| 3079 VH3-23_IGHD3-10*01 > 3_IGHJ5*01 | 1620 | gnl\|Fabrus\|A26_IGKJ1*01 | 1079 |
| 3080 VH3-23_IGHD3-16*01 > 2_IGHJ5*01 | 1621 | gnl\|Fabrus\|A26_IGKJ1*01 | 1079 |
| 3081 VH3-23_IGHD3-16*01 > 3_IGHJ5*01 | 1622 | gnl\|Fabrus\|A26_IGKJ1*01 | 1079 |
| 3082 VH3-23_IGHD3-22*01 > 2_IGHJ5*01 | 1623 | gnl\|Fabrus\|A26_IGKJ1*01 | 1079 |
| 3083 VH3-23_IGHD3-22*01 > 3_IGHJ5*01 | 1624 | gnl\|Fabrus\|A26_IGKJ1*01 | 1079 |
| 3084 VH3-23_IGHD4-4*01 (1) > 2_IGHJ5*01 | 1625 | gnl\|Fabrus\|A26_IGKJ1*01 | 1079 |
| 3085 VH3-23_IGHD4-4*01 (1) > 3_IGHJ5*01 | 1626 | gnl\|Fabrus\|A26_IGKJ1*01 | 1079 |
| 3086 VH3-23_IGHD4-11*01 (1) > 2_IGHJ5*01 | 1627 | gnl\|Fabrus\|A26_IGKJ1*01 | 1079 |
| 3087 VH3-23_IGHD4-11*01 (1) > 3_IGHJ5*01 | 1628 | gnl\|Fabrus\|A26_IGKJ1*01 | 1079 |
| 3088 VH3-23_IGHD4-17*01 > 2_IGHJ5*01 | 1629 | gnl\|Fabrus\|A26_IGKJ1*01 | 1079 |
| 3089 VH3-23_IGHD4-17*01 > 3_IGHJ5*01 | 1630 | gnl\|Fabrus\|A26_IGKJ1*01 | 1079 |
| 3090 VH3-23_IGHD4-23*01 > 2_IGHJ5*01 | 1631 | gnl\|Fabrus\|A26_IGKJ1*01 | 1079 |
| 3091 VH3-23_IGHD4-23*01 > 3_IGHJ5*01 | 1632 | gnl\|Fabrus\|A26_IGKJ1*01 | 1079 |
| 3092 VH3-23_IGHD5-5*01 (2) > 1_IGHJ5*01 | 1633 | gnl\|Fabrus\|A26_IGKJ1*01 | 1079 |
| 3093 VH3-23_IGHD5-5*01 (2) > 2_IGHJ5*01 | 1634 | gnl\|Fabrus\|A26_IGKJ1*01 | 1079 |
| 3094 VH3-23_IGHD5-5*01 (2) > 3_IGHJ5*01 | 1635 | gnl\|Fabrus\|A26_IGKJ1*01 | 1079 |
| 3095 VH3-23_IGHD5-12*01 > 1_IGHJ5*01 | 1636 | gnl\|Fabrus\|A26_IGKJ1*01 | 1079 |
| 3096 VH3-23_IGHD5-12*01 > 3_IGHJ5*01 | 1637 | gnl\|Fabrus\|A26_IGKJ1*01 | 1079 |
| 3097 VH3-23_IGHD5-18*01 (2) > 1_IGHJ5*01 | 1638 | gnl\|Fabrus\|A26_IGKJ1*01 | 1079 |
| 3098 VH3-23_IGHD5-18*01 (2) > 2_IGHJ5*01 | 1639 | gnl\|Fabrus\|A26_IGKJ1*01 | 1079 |
| 3099 VH3-23_IGHD5-18*01 (2) > 3_IGHJ5*01 | 1640 | gnl\|Fabrus\|A26_IGKJ1*01 | 1079 |
| 3100 VH3-23_IGHD5-24*01 > 1_IGHJ5*01 | 1641 | gnl\|Fabrus\|A26_IGKJ1*01 | 1079 |
| 3101 VH3-23_IGHD5-24*01 > 3_IGHJ5*01 | 1642 | gnl\|Fabrus\|A26_IGKJ1*01 | 1079 |
| 3102 VH3-23_IGHD6-6*01 > 1_IGHJ5*01 | 1643 | gnl\|Fabrus\|A26_IGKJ1*01 | 1079 |
| 3103 VH3-23_IGHD1-1*01 > 1'_IGHJ5*01 | 1653 | gnl\|Fabrus\|A26_IGKJ1*01 | 1079 |
| 3104 VH3-23_IGHD1-1*01 > 2'_IGHJ5*01 | 1654 | gnl\|Fabrus\|A26_IGKJ1*01 | 1079 |
| 3105 VH3-23_IGHD1-1*01 > 3'_IGHJ5*01 | 1655 | gnl\|Fabrus\|A26_IGKJ1*01 | 1079 |
| 3106 VH3-23_IGHD1-7*01 > 1'_IGHJ5*01 | 1656 | gnl\|Fabrus\|A26_IGKJ1*01 | 1079 |
| 3107 VH3-23_IGHD1-7*01 > 3'_IGHJ5*01 | 1657 | gnl\|Fabrus\|A26_IGKJ1*01 | 1079 |
| 3108 VH3-23_IGHD1-14*01 > 1'_IGHJ5*01 | 1658 | gnl\|Fabrus\|A26_IGKJ1*01 | 1079 |
| 3109 VH3-23_IGHD1-14*01 > 2'_IGHJ5*01 | 1659 | gnl\|Fabrus\|A26_IGKJ1*01 | 1079 |
| 3110 VH3-23_IGHD1-14*01 > 3'_IGHJ5*01 | 1660 | gnl\|Fabrus\|A26_IGKJ1*01 | 1079 |
| 3111 VH3-23_IGHD1-20*01 > 1'_IGHJ5*01 | 1661 | gnl\|Fabrus\|A26_IGKJ1*01 | 1079 |
| 3112 VH3-23_IGHD1-20*01 > 2'_IGHJ5*01 | 1662 | gnl\|Fabrus\|A26_IGKJ1*01 | 1079 |
| 3113 VH3-23_IGHD1-20*01 > 3'_IGHJ5*01 | 1663 | gnl\|Fabrus\|A26_IGKJ1*01 | 1079 |
| 3114 VH3-23_IGHD1-26*01 > 1'_IGHJ5*01 | 1664 | gnl\|Fabrus\|A26_IGKJ1*01 | 1079 |
| 3115 VH3-23_IGHD1-26*01 > 3'_IGHJ5*01 | 1665 | gnl\|Fabrus\|A26_IGKJ1*01 | 1079 |
| 3116 VH3-23_IGHD2-2*01 > 1'_IGHJ5*01 | 1666 | gnl\|Fabrus\|A26_IGKJ1*01 | 1079 |
| 3117 VH3-23_IGHD2-2*01 > 3'_IGHJ5*01 | 1667 | gnl\|Fabrus\|A26_IGKJ1*01 | 1079 |
| 3118 VH3-23_IGHD2-8*01 > 1'_IGHJ5*01 | 1668 | gnl\|Fabrus\|A26_IGKJ1*01 | 1079 |
| 3119 VH3-23_IGHD2-15*01 > 1'_IGHJ5*01 | 1669 | gnl\|Fabrus\|A26_IGKJ1*01 | 1079 |
| 3120 VH3-23_IGHD2-15*01 > 3'_IGHJ5*01 | 1670 | gnl\|Fabrus\|A26_IGKJ1*01 | 1079 |
| 3121 VH3-23_IGHD2-21*01 > 1'_IGHJ5*01 | 1671 | gnl\|Fabrus\|A26_IGKJ1*01 | 1079 |
| 3122 VH3-23_IGHD2-21*01 > 3'_IGHJ5*01 | 1672 | gnl\|Fabrus\|A26_IGKJ1*01 | 1079 |
| 3123 VH3-23_IGHD3-3*01 > 1'_IGHJ5*01 | 1673 | gnl\|Fabrus\|A26_IGKJ1*01 | 1079 |
| 3124 VH3-23_IGHD3-3*01 > 3'_IGHJ5*01 | 1674 | gnl\|Fabrus\|A26_IGKJ1*01 | 1079 |
| 3125 VH3-23_IGHD3-9*01 > 1'_IGHJ5*01 | 1675 | gnl\|Fabrus\|A26_IGKJ1*01 | 1079 |

TABLE 4-continued

Exemplary Paired Nucleic Acid Library

| HEAVY CHAIN | SEQ ID NO | LIGHT CHAIN | SEQ ID NO |
|---|---|---|---|
| 3126 VH3-23_IGHD3-9*01 > 3'_IGHJ5*01 | 1676 | gnl\|Fabrus\|A26_IGKJ1*01 | 1079 |
| 3127 VH3-23_IGHD3-10*01 > 1'_IGHJ5*01 | 1677 | gnl\|Fabrus\|A26_IGKJ1*01 | 1079 |
| 3128 VH3-23_IGHD3-10*01 > 3'_IGHJ5*01 | 1678 | gnl\|Fabrus\|A26_IGKJ1*01 | 1079 |
| 3129 VH3-23_IGHD3-16*01 > 1'_IGHJ5*01 | 1679 | gnl\|Fabrus\|A26_IGKJ1*01 | 1079 |
| 3130 VH3-23_IGHD3-16*01 > 3'_IGHJ5*01 | 1680 | gnl\|Fabrus\|A26_IGKJ1*01 | 1079 |
| 3131 VH3-23_IGHD3-22*01 > 1'_IGHJ5*01 | 1681 | gnl\|Fabrus\|A26_IGKJ1*01 | 1079 |
| 3132 VH3-23_IGHD4-4*01 (1) > 1'_IGHJ5*01 | 1682 | gnl\|Fabrus\|A26_IGKJ1*01 | 1079 |
| 3133 VH3-23_IGHD4-4*01 (1) > 3'_IGHJ5*01 | 1683 | gnl\|Fabrus\|A26_IGKJ1*01 | 1079 |
| 3134 VH3-23_IGHD4-11*01 (1) > 1'_IGHJ5*01 | 1684 | gnl\|Fabrus\|A26_IGKJ1*01 | 1079 |
| 3135 VH3-23_IGHD4-11*01 (1) > 3'_IGHJ5*01 | 1685 | gnl\|Fabrus\|A26_IGKJ1*01 | 1079 |
| 3136 VH3-23_IGHD4-17*01 > 1'_IGHJ5*01 | 1686 | gnl\|Fabrus\|A26_IGKJ1*01 | 1079 |
| 3137 VH3-23_IGHD4-17*01 > 3'_IGHJ5*01 | 1687 | gnl\|Fabrus\|A26_IGKJ1*01 | 1079 |
| 3138 VH3-23_IGHD4-23*01 > 1'_IGHJ5*01 | 1688 | gnl\|Fabrus\|A26_IGKJ1*01 | 1079 |
| 3139 VH3-23_IGHD4-23*01 > 3'_IGHJ5*01 | 1689 | gnl\|Fabrus\|A26_IGKJ1*01 | 1079 |
| 3140 VH3-23_IGHD5-5*01 (2) > 1'_IGHJ5*01 | 1690 | gnl\|Fabrus\|A26_IGKJ1*01 | 1079 |
| 3141 VH3-23_IGHD5-5*01 (2) > 3'_IGHJ5*01 | 1691 | gnl\|Fabrus\|A26_IGKJ1*01 | 1079 |
| 3142 VH3-23_IGHD5-12*01 > 1'_IGHJ5*01 | 1692 | gnl\|Fabrus\|A26_IGKJ1*01 | 1079 |
| 3143 VH3-23_IGHD5-12*01 > 3'_IGHJ5*01 | 1693 | gnl\|Fabrus\|A26_IGKJ1*01 | 1079 |
| 3144 VH3-23_IGHD5-18*01 (2) > 1'_IGHJ5*01 | 1694 | gnl\|Fabrus\|A26_IGKJ1*01 | 1079 |
| 3145 VH3-23_IGHD5-18*01 (2) > 3'_IGHJ5*01 | 1695 | gnl\|Fabrus\|A26_IGKJ1*01 | 1079 |
| 3146 VH3-23_IGHD5-24*01 > 1'_IGHJ5*01 | 1696 | gnl\|Fabrus\|A26_IGKJ1*01 | 1079 |
| 3147 VH3-23_IGHD5-24*01 > 3'_IGHJ5*01 | 1697 | gnl\|Fabrus\|A26_IGKJ1*01 | 1079 |
| 3148 VH3-23_IGHD6-6*01 > 1'_IGHJ5*01 | 1698 | gnl\|Fabrus\|A26_IGKJ1*01 | 1079 |
| 3149 VH3-23_IGHD6-6*01 > 2'_IGHJ5*01 | 1699 | gnl\|Fabrus\|A26_IGKJ1*01 | 1079 |
| 3150 VH3-23_IGHD6-6*01 > 3'_IGHJ5*01 | 1700 | gnl\|Fabrus\|A26_IGKJ1*01 | 1079 |
| 3151 VH3-23_IGHD1-1*01 > 1_IGHJ5*01 | 1596 | gnl\|Fabrus\|A14_IGKJ1*01 | 1074 |
| 3152 VH3-23_IGHD1-1*01 > 2_IGHJ5*01 | 1597 | gnl\|Fabrus\|A14_IGKJ1*01 | 1074 |
| 3153 VH3-23_IGHD1-1*01 > 3_IGHJ5*01 | 1598 | gnl\|Fabrus\|A14_IGKJ1*01 | 1074 |
| 3154 VH3-23_IGHD1-7*01 > 1_IGHJ5*01 | 1599 | gnl\|Fabrus\|A14_IGKJ1*01 | 1074 |
| 3155 VH3-23_IGHD1-7*01 > 3_IGHJ5*01 | 1600 | gnl\|Fabrus\|A14_IGKJ1*01 | 1074 |
| 3156 VH3-23_IGHD1-14*01 > 1_IGHJ5*01 | 1601 | gnl\|Fabrus\|A14_IGKJ1*01 | 1074 |
| 3157 VH3-23_IGHD1-14*01 > 3_IGHJ5*01 | 1602 | gnl\|Fabrus\|A14_IGKJ1*01 | 1074 |
| 3158 VH3-23_IGHD1-20*01 > 1_IGHJ5*01 | 1603 | gnl\|Fabrus\|A14_IGKJ1*01 | 1074 |
| 3159 VH3-23_IGHD1-20*01 > 3_IGHJ5*01 | 1604 | gnl\|Fabrus\|A14_IGKJ1*01 | 1074 |
| 3160 VH3-23_IGHD1-26*01 > 1_IGHJ5*01 | 1605 | gnl\|Fabrus\|A14_IGKJ1*01 | 1074 |
| 3161 VH3-23_IGHD1-26*01 > 3_IGHJ5*01 | 1606 | gnl\|Fabrus\|A14_IGKJ1*01 | 1074 |
| 3162 VH3-23_IGHD2-2*01 > 2_IGHJ5*01 | 1607 | gnl\|Fabrus\|A14_IGKJ1*01 | 1074 |
| 3163 VH3-23_IGHD2-2*01 > 3_IGHJ5*01 | 1608 | gnl\|Fabrus\|A14_IGKJ1*01 | 1074 |
| 3164 VH3-23_IGHD2-8*01 > 2_IGHJ5*01 | 1609 | gnl\|Fabrus\|A14_IGKJ1*01 | 1074 |
| 3165 VH3-23_IGHD2-8*01 > 3_IGHJ5*01 | 1610 | gnl\|Fabrus\|A14_IGKJ1*01 | 1074 |
| 3166 VH3-23_IGHD2-15*01 > 2_IGHJ5*01 | 1611 | gnl\|Fabrus\|A14_IGKJ1*01 | 1074 |
| 3167 VH3-23_IGHD2-15*01 > 3_IGHJ5*01 | 1612 | gnl\|Fabrus\|A14_IGKJ1*01 | 1074 |
| 3168 VH3-23_IGHD2-21*01 > 2_IGHJ5*01 | 1613 | gnl\|Fabrus\|A14_IGKJ1*01 | 1074 |
| 3169 VH3-23_IGHD2-21*01 > 3_IGHJ5*01 | 1614 | gnl\|Fabrus\|A14_IGKJ1*01 | 1074 |
| 3170 VH3-23_IGHD3-3*01 > 1_IGHJ5*01 | 1615 | gnl\|Fabrus\|A14_IGKJ1*01 | 1074 |
| 3171 VH3-23_IGHD3-3*01 > 2_IGHJ5*01 | 1616 | gnl\|Fabrus\|A14_IGKJ1*01 | 1074 |
| 3172 VH3-23_IGHD3-3*01 > 3_IGHJ5*01 | 1617 | gnl\|Fabrus\|A14_IGKJ1*01 | 1074 |
| 3173 VH3-23_IGHD3-9*01 > 2_IGHJ5*01 | 1618 | gnl\|Fabrus\|A14_IGKJ1*01 | 1074 |
| 3174 VH3-23_IGHD3-10*01 > 2_IGHJ5*01 | 1619 | gnl\|Fabrus\|A14_IGKJ1*01 | 1074 |
| 3175 VH3-23_IGHD3-10*01 > 3_IGHJ5*01 | 1620 | gnl\|Fabrus\|A14_IGKJ1*01 | 1074 |
| 3176 VH3-23_IGHD3-16*01 > 2_IGHJ5*01 | 1621 | gnl\|Fabrus\|A14_IGKJ1*01 | 1074 |
| 3177 VH3-23_IGHD3-16*01 > 3_IGHJ5*01 | 1622 | gnl\|Fabrus\|A14_IGKJ1*01 | 1074 |
| 3178 VH3-23_IGHD3-22*01 > 2_IGHJ5*01 | 1623 | gnl\|Fabrus\|A14_IGKJ1*01 | 1074 |
| 3179 VH3-23_IGHD3-22*01 > 3_IGHJ5*01 | 1624 | gnl\|Fabrus\|A14_IGKJ1*01 | 1074 |
| 3180 VH3-23_IGHD4-4*01 (1) > 2_IGHJ5*01 | 1625 | gnl\|Fabrus\|A14_IGKJ1*01 | 1074 |
| 3181 VH3-23_IGHD4-4*01 (1) > 3_IGHJ5*01 | 1626 | gnl\|Fabrus\|A14_IGKJ1*01 | 1074 |
| 3182 VH3-23_IGHD4-11*01 (1) > 2_IGHJ5*01 | 1627 | gnl\|Fabrus\|A14_IGKJ1*01 | 1074 |
| 3183 VH3-23_IGHD4-11*01 (1) > 3_IGHJ5*01 | 1628 | gnl\|Fabrus\|A14_IGKJ1*01 | 1074 |
| 3184 VH3-23_IGHD4-17*01 > 2_IGHJ5*01 | 1629 | gnl\|Fabrus\|A14_IGKJ1*01 | 1074 |
| 3185 VH3-23_IGHD4-17*01 > 3_IGHJ5*01 | 1630 | gnl\|Fabrus\|A14_IGKJ1*01 | 1074 |
| 3186 VH3-23_IGHD4-23*01 > 2_IGHJ5*01 | 1631 | gnl\|Fabrus\|A14_IGKJ1*01 | 1074 |
| 3187 VH3-23_IGHD4-23*01 > 3_IGHJ5*01 | 1632 | gnl\|Fabrus\|A14_IGKJ1*01 | 1074 |
| 3188 VH3-23_IGHD5-5*01 (2) > 1_IGHJ5*01 | 1633 | gnl\|Fabrus\|A14_IGKJ1*01 | 1074 |
| 3189 VH3-23_IGHD5-5*01 (2) > 2_IGHJ5*01 | 1634 | gnl\|Fabrus\|A14_IGKJ1*01 | 1074 |
| 3190 VH3-23_IGHD5-5*01 (2) > 3_IGHJ5*01 | 1635 | gnl\|Fabrus\|A14_IGKJ1*01 | 1074 |
| 3191 VH3-23_IGHD5-12*01 > 1_IGHJ5*01 | 1636 | gnl\|Fabrus\|A14_IGKJ1*01 | 1074 |
| 3192 VH3-23_IGHD5-12*01 > 3_IGHJ5*01 | 1637 | gnl\|Fabrus\|A14_IGKJ1*01 | 1074 |
| 3193 VH3-23_IGHD5-18*01 (2) > 1_IGHJ5*01 | 1638 | gnl\|Fabrus\|A14_IGKJ1*01 | 1074 |
| 3194 VH3-23_IGHD5-18*01 (2) > 2_IGHJ5*01 | 1639 | gnl\|Fabrus\|A14_IGKJ1*01 | 1074 |
| 3195 VH3-23_IGHD5-18*01 (2) > 3_IGHJ5*01 | 1640 | gnl\|Fabrus\|A14_IGKJ1*01 | 1074 |
| 3196 VH3-23_IGHD5-24*01 > 1_IGHJ5*01 | 1641 | gnl\|Fabrus\|A14_IGKJ1*01 | 1074 |
| 3197 VH3-23_IGHD5-24*01 > 3_IGHJ5*01 | 1642 | gnl\|Fabrus\|A14_IGKJ1*01 | 1074 |
| 3198 VH3-23_IGHD6-6*01 > 1_IGHJ5*01 | 1643 | gnl\|Fabrus\|A14_IGKJ1*01 | 1074 |
| 3199 VH3-23_IGHD1-1*01 > 1'_IGHJ5*01 | 1653 | gnl\|Fabrus\|A14_IGKJ1*01 | 1074 |

TABLE 4-continued

Exemplary Paired Nucleic Acid Library

| | HEAVY CHAIN | SEQ ID NO | LIGHT CHAIN | SEQ ID NO |
|---|---|---|---|---|
| 3200 | VH3-23_IGHD1-1*01 > 2'_IGHJ5*01 | 1654 | gnl\|Fabrus\|A14_IGKJ1*01 | 1074 |
| 3201 | VH3-23_IGHD1-1*01 > 3'_IGHJ5*01 | 1655 | gnl\|Fabrus\|A14_IGKJ1*01 | 1074 |
| 3202 | VH3-23_IGHD1-7*01 > 1'_IGHJ5*01 | 1656 | gnl\|Fabrus\|A14_IGKJ1*01 | 1074 |
| 3203 | VH3-23_IGHD1-7*01 > 3'_IGHJ5*01 | 1657 | gnl\|Fabrus\|A14_IGKJ1*01 | 1074 |
| 3204 | VH3-23_IGHD1-14*01 > 1'_IGHJ5*01 | 1658 | gnl\|Fabrus\|A14_IGKJ1*01 | 1074 |
| 3205 | VH3-23_IGHD1-14*01 > 2'_IGHJ5*01 | 1659 | gnl\|Fabrus\|A14_IGKJ1*01 | 1074 |
| 3206 | VH3-23_IGHD1-14*01 > 3'_IGHJ5*01 | 1660 | gnl\|Fabrus\|A14_IGKJ1*01 | 1074 |
| 3207 | VH3-23_IGHD1-20*01 > 1'_IGHJ5*01 | 1661 | gnl\|Fabrus\|A14_IGKJ1*01 | 1074 |
| 3208 | VH3-23_IGHD1-20*01 > 2'_IGHJ5*01 | 1662 | gnl\|Fabrus\|A14_IGKJ1*01 | 1074 |
| 3209 | VH3-23_IGHD1-20*01 > 3'_IGHJ5*01 | 1663 | gnl\|Fabrus\|A14_IGKJ1*01 | 1074 |
| 3210 | VH3-23_IGHD1-26*01 > 1'_IGHJ5*01 | 1664 | gnl\|Fabrus\|A14_IGKJ1*01 | 1074 |
| 3211 | VH3-23_IGHD1-26*01 > 3'_IGHJ5*01 | 1665 | gnl\|Fabrus\|A14_IGKJ1*01 | 1074 |
| 3212 | VH3-23_IGHD2-2*01 > 1'_IGHJ5*01 | 1666 | gnl\|Fabrus\|A14_IGKJ1*01 | 1074 |
| 3213 | VH3-23_IGHD2-2*01 > 3'_IGHJ5*01 | 1667 | gnl\|Fabrus\|A14_IGKJ1*01 | 1074 |
| 3214 | VH3-23_IGHD2-8*01 > 1'_IGHJ5*01 | 1668 | gnl\|Fabrus\|A14_IGKJ1*01 | 1074 |
| 3215 | VH3-23_IGHD2-15*01 > 1'_IGHJ5*01 | 1669 | gnl\|Fabrus\|A14_IGKJ1*01 | 1074 |
| 3216 | VH3-23_IGHD2-15*01 > 3'_IGHJ5*01 | 1670 | gnl\|Fabrus\|A14_IGKJ1*01 | 1074 |
| 3217 | VH3-23_IGHD2-21*01 > 1'_IGHJ5*01 | 1671 | gnl\|Fabrus\|A14_IGKJ1*01 | 1074 |
| 3218 | VH3-23_IGHD2-21*01 > 3'_IGHJ5*01 | 1672 | gnl\|Fabrus\|A14_IGKJ1*01 | 1074 |
| 3219 | VH3-23_IGHD3-3*01 > 1'_IGHJ5*01 | 1673 | gnl\|Fabrus\|A14_IGKJ1*01 | 1074 |
| 3220 | VH3-23_IGHD3-3*01 > 3'_IGHJ5*01 | 1674 | gnl\|Fabrus\|A14_IGKJ1*01 | 1074 |
| 3221 | VH3-23_IGHD3-9*01 > 1'_IGHJ5*01 | 1675 | gnl\|Fabrus\|A14_IGKJ1*01 | 1074 |
| 3222 | VH3-23_IGHD3-9*01 > 3'_IGHJ5*01 | 1676 | gnl\|Fabrus\|A14_IGKJ1*01 | 1074 |
| 3223 | VH3-23_IGHD3-10*01 > 1'_IGHJ5*01 | 1677 | gnl\|Fabrus\|A14_IGKJ1*01 | 1074 |
| 3224 | VH3-23_IGHD3-10*01 > 3'_IGHJ5*01 | 1678 | gnl\|Fabrus\|A14_IGKJ1*01 | 1074 |
| 3225 | VH3-23_IGHD3-16*01 > 1'_IGHJ5*01 | 1679 | gnl\|Fabrus\|A14_IGKJ1*01 | 1074 |
| 3226 | VH3-23_IGHD3-16*01 > 3'_IGHJ5*01 | 1680 | gnl\|Fabrus\|A14_IGKJ1*01 | 1074 |
| 3227 | VH3-23_IGHD3-22*01 > 1'_IGHJ5*01 | 1681 | gnl\|Fabrus\|A14_IGKJ1*01 | 1074 |
| 3228 | VH3-23_IGHD4-4*01 (1) > 1'_IGHJ5*01 | 1682 | gnl\|Fabrus\|A14_IGKJ1*01 | 1074 |
| 3229 | VH3-23_IGHD4-4*01 (1) > 3'_IGHJ5*01 | 1683 | gnl\|Fabrus\|A14_IGKJ1*01 | 1074 |
| 3230 | VH3-23_IGHD4-11*01 (1) > 1'_IGHJ5*01 | 1684 | gnl\|Fabrus\|A14_IGKJ1*01 | 1074 |
| 3231 | VH3-23_IGHD4-11*01 (1) > 3'_IGHJ5*01 | 1685 | gnl\|Fabrus\|A14_IGKJ1*01 | 1074 |
| 3232 | VH3-23_IGHD4-17*01 > 1'_IGHJ5*01 | 1686 | gnl\|Fabrus\|A14_IGKJ1*01 | 1074 |
| 3233 | VH3-23_IGHD4-17*01 > 3'_IGHJ5*01 | 1687 | gnl\|Fabrus\|A14_IGKJ1*01 | 1074 |
| 3234 | VH3-23_IGHD4-23*01 > 1'_IGHJ5*01 | 1688 | gnl\|Fabrus\|A14_IGKJ1*01 | 1074 |
| 3235 | VH3-23_IGHD4-23*01 > 3'_IGHJ5*01 | 1689 | gnl\|Fabrus\|A14_IGKJ1*01 | 1074 |
| 3236 | VH3-23_IGHD5-5*01 (2) > 1'_IGHJ5*01 | 1690 | gnl\|Fabrus\|A14_IGKJ1*01 | 1074 |
| 3237 | VH3-23_IGHD5-5*01 (2) > 3'_IGHJ5*01 | 1691 | gnl\|Fabrus\|A14_IGKJ1*01 | 1074 |
| 3238 | VH3-23_IGHD5-12*01 > 1'_IGHJ5*01 | 1692 | gnl\|Fabrus\|A14_IGKJ1*01 | 1074 |
| 3239 | VH3-23_IGHD5-12*01 > 3'_IGHJ5*01 | 1693 | gnl\|Fabrus\|A14_IGKJ1*01 | 1074 |
| 3240 | VH3-23_IGHD5-18*01 (2) > 1'_IGHJ5*01 | 1694 | gnl\|Fabrus\|A14_IGKJ1*01 | 1074 |
| 3241 | VH3-23_IGHD5-18*01 (2) > 3'_IGHJ5*01 | 1695 | gnl\|Fabrus\|A14_IGKJ1*01 | 1074 |
| 3242 | VH3-23_IGHD5-24*01 > 1'_IGHJ5*01 | 1696 | gnl\|Fabrus\|A14_IGKJ1*01 | 1074 |
| 3243 | VH3-23_IGHD5-24*01 > 3'_IGHJ5*01 | 1697 | gnl\|Fabrus\|A14_IGKJ1*01 | 1074 |
| 3244 | VH3-23_IGHD6-6*01 > 1'_IGHJ5*01 | 1698 | gnl\|Fabrus\|A14_IGKJ1*01 | 1074 |
| 3245 | VH3-23_IGHD6-6*01 > 2'_IGHJ5*01 | 1699 | gnl\|Fabrus\|A14_IGKJ1*01 | 1074 |
| 3246 | VH3-23_IGHD6-6*01 > 3'_IGHJ5*01 | 1700 | gnl\|Fabrus\|A14_IGKJ1*01 | 1074 |
| 3247 | VH3-23_IGHD1-1*01 > 1_IGHJ5*01 | 1596 | gnl\|Fabrus\|A27_IGKJ1*01 | 1080 |
| 3248 | VH3-23_IGHD1-1*01 > 2_IGHJ5*01 | 1597 | gnl\|Fabrus\|A27_IGKJ1*01 | 1080 |
| 3249 | VH3-23_IGHD1-1*01 > 3_IGHJ5*01 | 1598 | gnl\|Fabrus\|A27_IGKJ1*01 | 1080 |
| 3250 | VH3-23_IGHD1-7*01 > 1_IGHJ5*01 | 1599 | gnl\|Fabrus\|A27_IGKJ1*01 | 1080 |
| 3251 | VH3-23_IGHD1-7*01 > 3_IGHJ5*01 | 1600 | gnl\|Fabrus\|A27_IGKJ1*01 | 1080 |
| 3252 | VH3-23_IGHD1-14*01 > 1_IGHJ5*01 | 1601 | gnl\|Fabrus\|A27_IGKJ1*01 | 1080 |
| 3253 | VH3-23_IGHD1-14*01 > 3_IGHJ5*01 | 1602 | gnl\|Fabrus\|A27_IGKJ1*01 | 1080 |
| 3254 | VH3-23_IGHD1-20*01 > 1_IGHJ5*01 | 1603 | gnl\|Fabrus\|A27_IGKJ1*01 | 1080 |
| 3255 | VH3-23_IGHD1-20*01 > 3_IGHJ5*01 | 1604 | gnl\|Fabrus\|A27_IGKJ1*01 | 1080 |
| 3256 | VH3-23_IGHD1-26*01 > 1_IGHJ5*01 | 1605 | gnl\|Fabrus\|A27_IGKJ1*01 | 1080 |
| 3257 | VH3-23_IGHD1-26*01 > 3_IGHJ5*01 | 1606 | gnl\|Fabrus\|A27_IGKJ1*01 | 1080 |
| 3258 | VH3-23_IGHD2-2*01 > 2_IGHJ5*01 | 1607 | gnl\|Fabrus\|A27_IGKJ1*01 | 1080 |
| 3259 | VH3-23_IGHD2-2*01 > 3_IGHJ5*01 | 1608 | gnl\|Fabrus\|A27_IGKJ1*01 | 1080 |
| 3260 | VH3-23_IGHD2-8*01 > 2_IGHJ5*01 | 1609 | gnl\|Fabrus\|A27_IGKJ1*01 | 1080 |
| 3261 | VH3-23_IGHD2-8*01 > 3_IGHJ5*01 | 1610 | gnl\|Fabrus\|A27_IGKJ1*01 | 1080 |
| 3262 | VH3-23_IGHD2-15*01 > 2_IGHJ5*01 | 1611 | gnl\|Fabrus\|A27_IGKJ1*01 | 1080 |
| 3263 | VH3-23_IGHD2-15*01 > 3_IGHJ5*01 | 1612 | gnl\|Fabrus\|A27_IGKJ1*01 | 1080 |
| 3264 | VH3-23_IGHD2-21*01 > 2_IGHJ5*01 | 1613 | gnl\|Fabrus\|A27_IGKJ1*01 | 1080 |
| 3265 | VH3-23_IGHD2-21*01 > 3_IGHJ5*01 | 1614 | gnl\|Fabrus\|A27_IGKJ1*01 | 1080 |
| 3266 | VH3-23_IGHD3-3*01 > 1_IGHJ5*01 | 1615 | gnl\|Fabrus\|A27_IGKJ1*01 | 1080 |
| 3267 | VH3-23_IGHD3-3*01 > 2_IGHJ5*01 | 1616 | gnl\|Fabrus\|A27_IGKJ1*01 | 1080 |
| 3268 | VH3-23_IGHD3-3*01 > 3_IGHJ5*01 | 1617 | gnl\|Fabrus\|A27_IGKJ1*01 | 1080 |
| 3269 | VH3-23_IGHD3-9*01 > 2_IGHJ5*01 | 1618 | gnl\|Fabrus\|A27_IGKJ1*01 | 1080 |
| 3270 | VH3-23_IGHD3-10*01 > 2_IGHJ5*01 | 1619 | gnl\|Fabrus\|A27_IGKJ1*01 | 1080 |
| 3271 | VH3-23_IGHD3-10*01 > 3_IGHJ5*01 | 1620 | gnl\|Fabrus\|A27_IGKJ1*01 | 1080 |
| 3272 | VH3-23_IGHD3-16*01 > 2_IGHJ5*01 | 1621 | gnl\|Fabrus\|A27_IGKJ1*01 | 1080 |
| 3273 | VH3-23_IGHD3-16*01 > 3_IGHJ5*01 | 1622 | gnl\|Fabrus\|A27_IGKJ1*01 | 1080 |

TABLE 4-continued

Exemplary Paired Nucleic Acid Library

| HEAVY CHAIN | SEQ ID NO | LIGHT CHAIN | SEQ ID NO |
|---|---|---|---|
| 3274 VH3-23_IGHD3-22*01 > 2_IGHJ5*01 | 1623 | gnl\|Fabrus\|A27_IGKJ1*01 | 1080 |
| 3275 VH3-23_IGHD3-22*01 > 3_IGHJ5*01 | 1624 | gnl\|Fabrus\|A27_IGKJ1*01 | 1080 |
| 3276 VH3-23_IGHD4-4*01 (1) > 2_IGHJ5*01 | 1625 | gnl\|Fabrus\|A27_IGKJ1*01 | 1080 |
| 3277 VH3-23_IGHD4-4*01 (1) > 3_IGHJ5*01 | 1626 | gnl\|Fabrus\|A27_IGKJ1*01 | 1080 |
| 3278 VH3-23_IGHD4-11*01 (1) > 2_IGHJ5*01 | 1627 | gnl\|Fabrus\|A27_IGKJ1*01 | 1080 |
| 3279 VH3-23_IGHD4-11*01 (1) > 3_IGHJ5*01 | 1628 | gnl\|Fabrus\|A27_IGKJ1*01 | 1080 |
| 3280 VH3-23_IGHD4-17*01 > 2_IGHJ5*01 | 1629 | gnl\|Fabrus\|A27_IGKJ1*01 | 1080 |
| 3281 VH3-23_IGHD4-17*01 > 3_IGHJ5*01 | 1630 | gnl\|Fabrus\|A27_IGKJ1*01 | 1080 |
| 3282 VH3-23_IGHD4-23*01 > 2_IGHJ5*01 | 1631 | gnl\|Fabrus\|A27_IGKJ1*01 | 1080 |
| 3283 VH3-23_IGHD4-23*01 > 3_IGHJ5*01 | 1632 | gnl\|Fabrus\|A27_IGKJ1*01 | 1080 |
| 3284 VH3-23_IGHD5-5*01 (2) > 1_IGHJ5*01 | 1633 | gnl\|Fabrus\|A27_IGKJ1*01 | 1080 |
| 3285 VH3-23_IGHD5-5*01 (2) > 2_IGHJ5*01 | 1634 | gnl\|Fabrus\|A27_IGKJ1*01 | 1080 |
| 3286 VH3-23_IGHD5-5*01 (2) > 3_IGHJ5*01 | 1635 | gnl\|Fabrus\|A27_IGKJ1*01 | 1080 |
| 3287 VH3-23_IGHD5-12*01 > 1_IGHJ5*01 | 1636 | gnl\|Fabrus\|A27_IGKJ1*01 | 1080 |
| 3288 VH3-23_IGHD5-12*01 > 3_IGHJ5*01 | 1637 | gnl\|Fabrus\|A27_IGKJ1*01 | 1080 |
| 3289 VH3-23_IGHD5-18*01 (2) > 1_IGHJ5*01 | 1638 | gnl\|Fabrus\|A27_IGKJ1*01 | 1080 |
| 3290 VH3-23_IGHD5-18*01 (2) > 2_IGHJ5*01 | 1639 | gnl\|Fabrus\|A27_IGKJ1*01 | 1080 |
| 3291 VH3-23_IGHD5-18*01 (2) > 3_IGHJ5*01 | 1640 | gnl\|Fabrus\|A27_IGKJ1*01 | 1080 |
| 3292 VH3-23_IGHD5-24*01 > 1_IGHJ5*01 | 1641 | gnl\|Fabrus\|A27_IGKJ1*01 | 1080 |
| 3293 VH3-23_IGHD5-24*01 > 3_IGHJ5*01 | 1642 | gnl\|Fabrus\|A27_IGKJ1*01 | 1080 |
| 3294 VH3-23_IGHD6-6*01 > 1_IGHJ5*01 | 1643 | gnl\|Fabrus\|A27_IGKJ1*01 | 1080 |
| 3295 VH3-23_IGHD1-1*01 > 1'_IGHJ5*01 | 1653 | gnl\|Fabrus\|A27_IGKJ1*01 | 1080 |
| 3296 VH3-23_IGHD1-1*01 > 2'_IGHJ5*01 | 1654 | gnl\|Fabrus\|A27_IGKJ1*01 | 1080 |
| 3297 VH3-23_IGHD1-1*01 > 3'_IGHJ5*01 | 1655 | gnl\|Fabrus\|A27_IGKJ1*01 | 1080 |
| 3298 VH3-23_IGHD1-7*01 > 1'_IGHJ5*01 | 1656 | gnl\|Fabrus\|A27_IGKJ1*01 | 1080 |
| 3299 VH3-23_IGHD1-7*01 > 3'_IGHJ5*01 | 1657 | gnl\|Fabrus\|A27_IGKJ1*01 | 1080 |
| 3300 VH3-23_IGHD1-14*01 > 1'_IGHJ5*01 | 1658 | gnl\|Fabrus\|A27_IGKJ1*01 | 1080 |
| 3301 VH3-23_IGHD1-14*01 > 2'_IGHJ5*01 | 1659 | gnl\|Fabrus\|A27_IGKJ1*01 | 1080 |
| 3302 VH3-23_IGHD1-14*01 > 3'_IGHJ5*01 | 1660 | gnl\|Fabrus\|A27_IGKJ1*01 | 1080 |
| 3303 VH3-23_IGHD1-20*01 > 1'_IGHJ5*01 | 1661 | gnl\|Fabrus\|A27_IGKJ1*01 | 1080 |
| 3304 VH3-23_IGHD1-20*01 > 2'_IGHJ5*01 | 1662 | gnl\|Fabrus\|A27_IGKJ1*01 | 1080 |
| 3305 VH3-23_IGHD1-20*01 > 3'_IGHJ5*01 | 1663 | gnl\|Fabrus\|A27_IGKJ1*01 | 1080 |
| 3306 VH3-23_IGHD1-26*01 > 1'_IGHJ5*01 | 1664 | gnl\|Fabrus\|A27_IGKJ1*01 | 1080 |
| 3307 VH3-23_IGHD1-26*01 > 3'_IGHJ5*01 | 1665 | gnl\|Fabrus\|A27_IGKJ1*01 | 1080 |
| 3308 VH3-23_IGHD2-2*01 > 1'_IGHJ5*01 | 1666 | gnl\|Fabrus\|A27_IGKJ1*01 | 1080 |
| 3309 VH3-23_IGHD2-2*01 > 3'_IGHJ5*01 | 1667 | gnl\|Fabrus\|A27_IGKJ1*01 | 1080 |
| 3310 VH3-23_IGHD2-8*01 > 1'_IGHJ5*01 | 1668 | gnl\|Fabrus\|A27_IGKJ1*01 | 1080 |
| 3311 VH3-23_IGHD2-15*01 > 1'_IGHJ5*01 | 1669 | gnl\|Fabrus\|A27_IGKJ1*01 | 1080 |
| 3312 VH3-23_IGHD2-15*01 > 3'_IGHJ5*01 | 1670 | gnl\|Fabrus\|A27_IGKJ1*01 | 1080 |
| 3313 VH3-23_IGHD2-21*01 > 1'_IGHJ5*01 | 1671 | gnl\|Fabrus\|A27_IGKJ1*01 | 1080 |
| 3314 VH3-23_IGHD2-21*01 > 3'_IGHJ5*01 | 1672 | gnl\|Fabrus\|A27_IGKJ1*01 | 1080 |
| 3315 VH3-23_IGHD3-3*01 > 1'_IGHJ5*01 | 1673 | gnl\|Fabrus\|A27_IGKJ1*01 | 1080 |
| 3316 VH3-23_IGHD3-3*01 > 3'_IGHJ5*01 | 1674 | gnl\|Fabrus\|A27_IGKJ1*01 | 1080 |
| 3317 VH3-23_IGHD3-9*01 > 1'_IGHJ5*01 | 1675 | gnl\|Fabrus\|A27_IGKJ1*01 | 1080 |
| 3318 VH3-23_IGHD3-9*01 > 3'_IGHJ5*01 | 1676 | gnl\|Fabrus\|A27_IGKJ1*01 | 1080 |
| 3319 VH3-23_IGHD3-10*01 > 1'_IGHJ5*01 | 1677 | gnl\|Fabrus\|A27_IGKJ1*01 | 1080 |
| 3320 VH3-23_IGHD3-10*01 > 3'_IGHJ5*01 | 1678 | gnl\|Fabrus\|A27_IGKJ1*01 | 1080 |
| 3321 VH3-23_IGHD3-16*01 > 1'_IGHJ5*01 | 1679 | gnl\|Fabrus\|A27_IGKJ1*01 | 1080 |
| 3322 VH3-23_IGHD3-16*01 > 3'_IGHJ5*01 | 1680 | gnl\|Fabrus\|A27_IGKJ1*01 | 1080 |
| 3323 VH3-23_IGHD3-22*01 > 1'_IGHJ5*01 | 1681 | gnl\|Fabrus\|A27_IGKJ1*01 | 1080 |
| 3324 VH3-23_IGHD4-4*01 (1) > 1'_IGHJ5*01 | 1682 | gnl\|Fabrus\|A27_IGKJ1*01 | 1080 |
| 3325 VH3-23_IGHD4-4*01 (1) > 3'_IGHJ5*01 | 1683 | gnl\|Fabrus\|A27_IGKJ1*01 | 1080 |
| 3326 VH3-23_IGHD4-11*01 (1) > 1'_IGHJ5*01 | 1684 | gnl\|Fabrus\|A27_IGKJ1*01 | 1080 |
| 3327 VH3-23_IGHD4-11*01 (1) > 3'_IGHJ5*01 | 1685 | gnl\|Fabrus\|A27_IGKJ1*01 | 1080 |
| 3328 VH3-23_IGHD4-17*01 > 1'_IGHJ5*01 | 1686 | gnl\|Fabrus\|A27_IGKJ1*01 | 1080 |
| 3329 VH3-23_IGHD4-17*01 > 3'_IGHJ5*01 | 1687 | gnl\|Fabrus\|A27_IGKJ1*01 | 1080 |
| 3330 VH3-23_IGHD4-23*01 > 1'_IGHJ5*01 | 1688 | gnl\|Fabrus\|A27_IGKJ1*01 | 1080 |
| 3331 VH3-23_IGHD4-23*01 > 3'_IGHJ5*01 | 1689 | gnl\|Fabrus\|A27_IGKJ1*01 | 1080 |
| 3332 VH3-23_IGHD5-5*01 (2) > 1'_IGHJ5*01 | 1690 | gnl\|Fabrus\|A27_IGKJ1*01 | 1080 |
| 3333 VH3-23_IGHD5-5*01 (2) > 3'_IGHJ5*01 | 1691 | gnl\|Fabrus\|A27_IGKJ1*01 | 1080 |
| 3334 VH3-23_IGHD5-12*01 > 1'_IGHJ5*01 | 1692 | gnl\|Fabrus\|A27_IGKJ1*01 | 1080 |
| 3335 VH3-23_IGHD5-12*01 > 3'_IGHJ5*01 | 1693 | gnl\|Fabrus\|A27_IGKJ1*01 | 1080 |
| 3336 VH3-23_IGHD5-18*01 (2) > 1'_IGHJ5*01 | 1694 | gnl\|Fabrus\|A27_IGKJ1*01 | 1080 |
| 3337 VH3-23_IGHD5-18*01 (2) > 3'_IGHJ5*01 | 1695 | gnl\|Fabrus\|A27_IGKJ1*01 | 1080 |
| 3338 VH3-23_IGHD5-24*01 > 1'_IGHJ5*01 | 1696 | gnl\|Fabrus\|A27_IGKJ1*01 | 1080 |
| 3339 VH3-23_IGHD5-24*01 > 3'_IGHJ5*01 | 1697 | gnl\|Fabrus\|A27_IGKJ1*01 | 1080 |
| 3340 VH3-23_IGHD6-6*01 > 1'_IGHJ5*01 | 1698 | gnl\|Fabrus\|A27_IGKJ1*01 | 1080 |
| 3341 VH3-23_IGHD6-6*01 > 2'_IGHJ5*01 | 1699 | gnl\|Fabrus\|A27_IGKJ1*01 | 1080 |
| 3342 VH3-23_IGHD6-6*01 > 3'_IGHJ5*01 | 1700 | gnl\|Fabrus\|A27_IGKJ1*01 | 1080 |
| 3343 VH3-23_IGHD6-6*01 > 2_IGHJ1*01 | 1184 | gnl\|Fabrus\|V1-11_IGLJ2*01 | 1104 |
| 3344 VH3-23_IGHD6-13*01 > 1_IGHJ1*01 | 1185 | gnl\|Fabrus\|V1-11_IGLJ2*01 | 1104 |
| 3345 VH3-23_IGHD6-13*01 > 2_IGHJ1*01 | 1186 | gnl\|Fabrus\|V1-11_IGLJ2*01 | 1104 |
| 3346 VH3-23_IGHD6-19*01 > 1_IGHJ1*01 | 1187 | gnl\|Fabrus\|V1-11_IGLJ2*01 | 1104 |
| 3347 VH3-23_IGHD6-19*01 > 2_IGHJ1*01 | 1188 | gnl\|Fabrus\|V1-11_IGLJ2*01 | 1104 |

TABLE 4-continued

Exemplary Paired Nucleic Acid Library

| | HEAVY CHAIN | SEQ ID NO | LIGHT CHAIN | SEQ ID NO |
|---|---|---|---|---|
| 3348 | VH3-23_IGHD6-25*01 > 1_IGHJ1*01 | 1189 | gnl|Fabrus|V1-11_IGLJ2*01 | 1104 |
| 3349 | VH3-23_IGHD6-25*01 > 2_IGHJ1*01 | 1190 | gnl|Fabrus|V1-11_IGLJ2*01 | 1104 |
| 3350 | VH3-23_IGHD7-27*01 > 1_IGHJ1*01 | 1191 | gnl|Fabrus|V1-11_IGLJ2*01 | 1104 |
| 3351 | VH3-23_IGHD7-27*01 > 3_IGHJ1*01 | 1192 | gnl|Fabrus|V1-11_IGLJ2*01 | 1104 |
| 3352 | VH3-23_IGHD6-13*01 > 1'_IGHJ1*01 | 1241 | gnl|Fabrus|V1-11_IGLJ2*01 | 1104 |
| 3353 | VH3-23_IGHD6-13*01 > 2'_IGHJ1*01 | 1242 | gnl|Fabrus|V1-11_IGLJ2*01 | 1104 |
| 3354 | VH3-23_IGHD6-13*01 > 2_IGHJ1*01_B | 1243 | gnl|Fabrus|V1-11_IGLJ2*01 | 1104 |
| 3355 | VH3-23_IGHD6-19*01 > 1'_IGHJ1*01 | 1244 | gnl|Fabrus|V1-11_IGLJ2*01 | 1104 |
| 3356 | VH3-23_IGHD6-19*01 > 2'_IGHJ1*01 | 1245 | gnl|Fabrus|V1-11_IGLJ2*01 | 1104 |
| 3357 | VH3-23_IGHD6-19*01 > 2_IGHJ1*01_B | 1246 | gnl|Fabrus|V1-11_IGLJ2*01 | 1104 |
| 3358 | VH3-23_IGHD6-25*01 > 1'_IGHJ1*01 | 1247 | gnl|Fabrus|V1-11_IGLJ2*01 | 1104 |
| 3359 | VH3-23_IGHD6-25*01 > 3'_IGHJ1*01 | 1248 | gnl|Fabrus|V1-11_IGLJ2*01 | 1104 |
| 3360 | VH3-23_IGHD7-27*01 > 1'_IGHJ1*01_B | 1249 | gnl|Fabrus|V1-11_IGLJ2*01 | 1104 |
| 3361 | VH3-23_IGHD7-27*01 > 2'_IGHJ1*01 | 1250 | gnl|Fabrus|V1-11_IGLJ2*01 | 1104 |
| 3362 | VH3-23_IGHD6-6*01 > 2_IGHJ2*01 | 1299 | gnl|Fabrus|V1-11_IGLJ2*01 | 1104 |
| 3363 | VH3-23_IGHD6-13*01 > 1_IGHJ2*01 | 1300 | gnl|Fabrus|V1-11_IGLJ2*01 | 1104 |
| 3364 | VH3-23_IGHD6-13*01 > 2_IGHJ2*01 | 1301 | gnl|Fabrus|V1-11_IGLJ2*01 | 1104 |
| 3365 | VH3-23_IGHD6-19*01 > 1_IGHJ2*01 | 1302 | gnl|Fabrus|V1-11_IGLJ2*01 | 1104 |
| 3366 | VH3-23_IGHD6-19*01 > 2_IGHJ2*01 | 1303 | gnl|Fabrus|V1-11_IGLJ2*01 | 1104 |
| 3367 | VH3-23_IGHD6-25*01 > 1_IGHJ2*01 | 1304 | gnl|Fabrus|V1-11_IGLJ2*01 | 1104 |
| 3368 | VH3-23_IGHD6-25*01 > 2_IGHJ2*01 | 1305 | gnl|Fabrus|V1-11_IGLJ2*01 | 1104 |
| 3369 | VH3-23_IGHD7-27*01 > 1_IGHJ2*01 | 1306 | gnl|Fabrus|V1-11_IGLJ2*01 | 1104 |
| 3370 | VH3-23_IGHD7-27*01 > 3_IGHJ2*01 | 1307 | gnl|Fabrus|V1-11_IGLJ2*01 | 1104 |
| 3371 | VH3-23_IGHD6-13*01 > 1'_IGHJ2*01 | 1356 | gnl|Fabrus|V1-11_IGLJ2*01 | 1104 |
| 3372 | VH3-23_IGHD6-13*01 > 2'_IGHJ2*01 | 1357 | gnl|Fabrus|V1-11_IGLJ2*01 | 1104 |
| 3373 | VH3-23_IGHD6-13*01 > 2_IGHJ2*01_B | 1358 | gnl|Fabrus|V1-11_IGLJ2*01 | 1104 |
| 3374 | VH3-23_IGHD6-19*01 > 1'_IGHJ2*01 | 1359 | gnl|Fabrus|V1-11_IGLJ2*01 | 1104 |
| 3375 | VH3-23_IGHD6-19*01 > 2'_IGHJ2*01 | 1360 | gnl|Fabrus|V1-11_IGLJ2*01 | 1104 |
| 3376 | VH3-23_IGHD6-19*01 > 2_IGHJ2*01_B | 1361 | gnl|Fabrus|V1-11_IGLJ2*01 | 1104 |
| 3377 | VH3-23_IGHD6-25*01 > 1'_IGHJ2*01 | 1362 | gnl|Fabrus|V1-11_IGLJ2*01 | 1104 |
| 3378 | VH3-23_IGHD6-25*01 > 3'_IGHJ2*01 | 1363 | gnl|Fabrus|V1-11_IGLJ2*01 | 1104 |
| 3379 | VH3-23_IGHD7-27*01 > 1'_IGHJ2*01 | 1364 | gnl|Fabrus|V1-11_IGLJ2*01 | 1104 |
| 3380 | VH3-23_IGHD7-27*01 > 2'_IGHJ2*01 | 1365 | gnl|Fabrus|V1-11_IGLJ2*01 | 1104 |
| 3381 | VH3-23_IGHD6-6*01 > 2_IGHJ3*01 | 1414 | gnl|Fabrus|V1-11_IGLJ2*01 | 1104 |
| 3382 | VH3-23_IGHD6-13*01 > 1_IGHJ3*01 | 1415 | gnl|Fabrus|V1-11_IGLJ2*01 | 1104 |
| 3383 | VH3-23_IGHD6-13*01 > 2_IGHJ3*01 | 1416 | gnl|Fabrus|V1-11_IGLJ2*01 | 1104 |
| 3384 | VH3-23_IGHD6-19*01 > 1_IGHJ3*01 | 1417 | gnl|Fabrus|V1-11_IGLJ2*01 | 1104 |
| 3385 | VH3-23_IGHD6-19*01 > 2_IGHJ3*01 | 1418 | gnl|Fabrus|V1-11_IGLJ2*01 | 1104 |
| 3386 | VH3-23_IGHD6-25*01 > 1_IGHJ3*01 | 1419 | gnl|Fabrus|V1-11_IGLJ2*01 | 1104 |
| 3387 | VH3-23_IGHD6-25*01 > 2_IGHJ3*01 | 1420 | gnl|Fabrus|V1-11_IGLJ2*01 | 1104 |
| 3388 | VH3-23_IGHD7-27*01 > 1_IGHJ3*01 | 1421 | gnl|Fabrus|V1-11_IGLJ2*01 | 1104 |
| 3389 | VH3-23_IGHD7-27*01 > 3_IGHJ3*01 | 1422 | gnl|Fabrus|V1-11_IGLJ2*01 | 1104 |
| 3390 | VH3-23_IGHD6-13*01 > 1'_IGHJ3*01 | 1471 | gnl|Fabrus|V1-11_IGLJ2*01 | 1104 |
| 3391 | VH3-23_IGHD6-13*01 > 2'_IGHJ3*01 | 1472 | gnl|Fabrus|V1-11_IGLJ2*01 | 1104 |
| 3392 | VH3-23_IGHD6-13*01 > 3'_IGHJ6*01 | 1818 | gnl|Fabrus|V1-11_IGLJ2*01 | 1104 |
| 3393 | VH3-23_IGHD6-19*01 > 1'_IGHJ3*01 | 1474 | gnl|Fabrus|V1-11_IGLJ2*01 | 1104 |
| 3394 | VH3-23_IGHD6-19*01 > 2'_IGHJ3*01 | 1475 | gnl|Fabrus|V1-11_IGLJ2*01 | 1104 |
| 3395 | VH3-23_IGHD6-19*01 > 3'_IGHJ3*01 | 1476 | gnl|Fabrus|V1-11_IGLJ2*01 | 1104 |
| 3396 | VH3-23_IGHD6-25*01 > 1'_IGHJ3*01 | 1477 | gnl|Fabrus|V1-11_IGLJ2*01 | 1104 |
| 3397 | VH3-23_IGHD6-25*01 > 3'_IGHJ3*01 | 1478 | gnl|Fabrus|V1-11_IGLJ2*01 | 1104 |
| 3398 | VH3-23_IGHD7-27*01 > 1'_IGHJ3*01 | 1479 | gnl|Fabrus|V1-11_IGLJ2*01 | 1104 |
| 3399 | VH3-23_IGHD7-27*01 > 2'_IGHJ3*01 | 1480 | gnl|Fabrus|V1-11_IGLJ2*01 | 1104 |
| 3400 | VH3-23_IGHD6-6*01 > 2_IGHJ4*01 | 1529 | gnl|Fabrus|V1-11_IGLJ2*01 | 1104 |
| 3401 | VH3-23_IGHD6-13*01 > 1_IGHJ4*01 | 1530 | gnl|Fabrus|V1-11_IGLJ2*01 | 1104 |
| 3402 | VH3-23_IGHD6-13*01 > 2_IGHJ4*01 | 1531 | gnl|Fabrus|V1-11_IGLJ2*01 | 1104 |
| 3403 | VH3-23_IGHD6-19*01 > 1_IGHJ4*01 | 1532 | gnl|Fabrus|V1-11_IGLJ2*01 | 1104 |
| 3404 | VH3-23_IGHD6-19*01 > 2_IGHJ4*01 | 1533 | gnl|Fabrus|V1-11_IGLJ2*01 | 1104 |
| 3405 | VH3-23_IGHD6-25*01 > 1_IGHJ4*01 | 1534 | gnl|Fabrus|V1-11_IGLJ2*01 | 1104 |
| 3406 | VH3-23_IGHD6-25*01 > 2_IGHJ4*01 | 1535 | gnl|Fabrus|V1-11_IGLJ2*01 | 1104 |
| 3407 | VH3-23_IGHD7-27*01 > 1_IGHJ4*01 | 1536 | gnl|Fabrus|V1-11_IGLJ2*01 | 1104 |
| 3408 | VH3-23_IGHD7-27*01 > 3_IGHJ4*01 | 1537 | gnl|Fabrus|V1-11_IGLJ2*01 | 1104 |
| 3409 | VH3-23_IGHD6-13*01 > 1'_IGHJ4*01 | 1586 | gnl|Fabrus|V1-11_IGLJ2*01 | 1104 |
| 3410 | VH3-23_IGHD6-13*01 > 2'_IGHJ4*01 | 1587 | gnl|Fabrus|V1-11_IGLJ2*01 | 1104 |
| 3411 | VH3-23_IGHD6-13*01 > 2_IGHJ4*01_B | 1588 | gnl|Fabrus|V1-11_IGLJ2*01 | 1104 |
| 3412 | VH3-23_IGHD6-19*01 > 1'_IGHJ4*01 | 1589 | gnl|Fabrus|V1-11_IGLJ2*01 | 1104 |
| 3413 | VH3-23_IGHD6-19*01 > 2'_IGHJ4*01 | 1590 | gnl|Fabrus|V1-11_IGLJ2*01 | 1104 |
| 3414 | VH3-23_IGHD6-19*01 > 2_IGHJ4*01_B | 1591 | gnl|Fabrus|V1-11_IGLJ2*01 | 1104 |
| 3415 | VH3-23_IGHD6-25*01 > 1'_IGHJ4*01 | 1592 | gnl|Fabrus|V1-11_IGLJ2*01 | 1104 |
| 3416 | VH3-23_IGHD6-25*01 > 3'_IGHJ4*01 | 1593 | gnl|Fabrus|V1-11_IGLJ2*01 | 1104 |
| 3417 | VH3-23_IGHD7-27*01 > 1'_IGHJ4*01 | 1594 | gnl|Fabrus|V1-11_IGLJ2*01 | 1104 |
| 3418 | VH3-23_IGHD7-27*01 > 2'_IGHJ4*01 | 1595 | gnl|Fabrus|V1-11_IGLJ2*01 | 1104 |
| 3419 | VH3-23_IGHD6-6*01 > 2_IGHJ5*01 | 1644 | gnl|Fabrus|V1-11_IGLJ2*01 | 1104 |
| 3420 | VH3-23_IGHD6-13*01 > 1_IGHJ5*01 | 1645 | gnl|Fabrus|V1-11_IGLJ2*01 | 1104 |
| 3421 | VH3-23_IGHD6-13*01 > 2_IGHJ5*01 | 1646 | gnl|Fabrus|V1-11_IGLJ2*01 | 1104 |

TABLE 4-continued

Exemplary Paired Nucleic Acid Library

| HEAVY CHAIN | SEQ ID NO | LIGHT CHAIN | SEQ ID NO |
|---|---|---|---|
| 3422 VH3-23_IGHD6-19*01 > 1_IGHJ5*01 | 1647 | gnl\|Fabrus\|V1-11_IGLJ2*01 | 1104 |
| 3423 VH3-23_IGHD6-19*01 > 2_IGHJ5*01 | 1648 | gnl\|Fabrus\|V1-11_IGLJ2*01 | 1104 |
| 3424 VH3-23_IGHD6-25*01 > 1_IGHJ5*01 | 1649 | gnl\|Fabrus\|V1-11_IGLJ2*01 | 1104 |
| 3425 VH3-23_IGHD6-25*01 > 2_IGHJ5*01 | 1650 | gnl\|Fabrus\|V1-11_IGLJ2*01 | 1104 |
| 3426 VH3-23_IGHD7-27*01 > 1_IGHJ5*01 | 1651 | gnl\|Fabrus\|V1-11_IGLJ2*01 | 1104 |
| 3427 VH3-23_IGHD7-27*01 > 3_IGHJ5*01 | 1652 | gnl\|Fabrus\|V1-11_IGLJ2*01 | 1104 |
| 3428 VH3-23_IGHD6-13*01 > 1'_IGHJ5*01 | 1701 | gnl\|Fabrus\|V1-11_IGLJ2*01 | 1104 |
| 3429 VH3-23_IGHD6-13*01 > 2'_IGHJ5*01 | 1702 | gnl\|Fabrus\|V1-11_IGLJ2*01 | 1104 |
| 3430 VH3-23_IGHD6-13*01 > 3'_IGHJ5*01 | 1703 | gnl\|Fabrus\|V1-11_IGLJ2*01 | 1104 |
| 3431 VH3-23_IGHD6-19*01 > 1'_IGHJ5*01 | 1704 | gnl\|Fabrus\|V1-11_IGLJ2*01 | 1104 |
| 3432 VH3-23_IGHD6-19*01 > 2'_IGHJ5*01 | 1705 | gnl\|Fabrus\|V1-11_IGLJ2*01 | 1104 |
| 3433 VH3-23_IGHD6-19*01 > 2'_IGHJ5*01_B | 1706 | gnl\|Fabrus\|V1-11_IGLJ2*01 | 1104 |
| 3434 VH3-23_IGHD6-25*01 > 1'_IGHJ5*01 | 1707 | gnl\|Fabrus\|V1-11_IGLJ2*01 | 1104 |
| 3435 VH3-23_IGHD6-25*01 > 3'_IGHJ5*01 | 1708 | gnl\|Fabrus\|V1-11_IGLJ2*01 | 1104 |
| 3436 VH3-23_IGHD7-27*01 > 1'_IGHJ5*01 | 1709 | gnl\|Fabrus\|V1-11_IGLJ2*01 | 1104 |
| 3437 VH3-23_IGHD7-27*01 > 2'_IGHJ5*01 | 1710 | gnl\|Fabrus\|V1-11_IGLJ2*01 | 1104 |
| 3438 VH3-23_IGHD6-6*01 > 2_IGHJ6*01 | 1759 | gnl\|Fabrus\|V1-11_IGLJ2*01 | 1104 |
| 3439 VH3-23_IGHD6-6*01 > 2_IGHJ1*01 | 1184 | gnl\|Fabrus\|V1-13_IGLJ5*01 | 1105 |
| 3440 VH3-23_IGHD6-13*01 > 1_IGHJ1*01 | 1185 | gnl\|Fabrus\|V1-13_IGLJ5*01 | 1105 |
| 3441 VH3-23_IGHD6-13*01 > 2_IGHJ1*01 | 1186 | gnl\|Fabrus\|V1-13_IGLJ5*01 | 1105 |
| 3442 VH3-23_IGHD6-19*01 > 1_IGHJ1*01 | 1187 | gnl\|Fabrus\|V1-13_IGLJ5*01 | 1105 |
| 3443 VH3-23_IGHD6-19*01 > 2_IGHJ1*01 | 1188 | gnl\|Fabrus\|V1-13_IGLJ5*01 | 1105 |
| 3444 VH3-23_IGHD6-25*01 > 1_IGHJ1*01 | 1189 | gnl\|Fabrus\|V1-13_IGLJ5*01 | 1105 |
| 3445 VH3-23_IGHD6-25*01 > 2_IGHJ1*01 | 1190 | gnl\|Fabrus\|V1-13_IGLJ5*01 | 1105 |
| 3446 VH3-23_IGHD7-27*01 > 1_IGHJ1*01 | 1191 | gnl\|Fabrus\|V1-13_IGLJ5*01 | 1105 |
| 3447 VH3-23_IGHD7-27*01 > 3_IGHJ1*01 | 1192 | gnl\|Fabrus\|V1-13_IGLJ5*01 | 1105 |
| 3448 VH3-23_IGHD6-13*01 > 1'_IGHJ1*01 | 1241 | gnl\|Fabrus\|V1-13_IGLJ5*01 | 1105 |
| 3449 VH3-23_IGHD6-13*01 > 2'_IGHJ1*01 | 1242 | gnl\|Fabrus\|V1-13_IGLJ5*01 | 1105 |
| 3450 VH3-23_IGHD6-13*01 > 2'_IGHJ1*01_B | 1243 | gnl\|Fabrus\|V1-13_IGLJ5*01 | 1105 |
| 3451 VH3-23_IGHD6-19*01 > 1'_IGHJ1*01 | 1244 | gnl\|Fabrus\|V1-13_IGLJ5*01 | 1105 |
| 3452 VH3-23_IGHD6-19*01 > 2'_IGHJ1*01 | 1245 | gnl\|Fabrus\|V1-13_IGLJ5*01 | 1105 |
| 3453 VH3-23_IGHD6-19*01 > 2'_IGHJ1*01_B | 1246 | gnl\|Fabrus\|V1-13_IGLJ5*01 | 1105 |
| 3454 VH3-23_IGHD6-25*01 > 1'_IGHJ1*01 | 1247 | gnl\|Fabrus\|V1-13_IGLJ5*01 | 1105 |
| 3455 VH3-23_IGHD6-25*01 > 3'_IGHJ1*01 | 1248 | gnl\|Fabrus\|V1-13_IGLJ5*01 | 1105 |
| 3456 VH3-23_IGHD7-27*01 > 1'_IGHJ1*01_B | 1249 | gnl\|Fabrus\|V1-13_IGLJ5*01 | 1105 |
| 3457 VH3-23_IGHD7-27*01 > 2'_IGHJ1*01 | 1250 | gnl\|Fabrus\|V1-13_IGLJ5*01 | 1105 |
| 3458 VH3-23_IGHD6-6*01 > 2_IGHJ2*01 | 1299 | gnl\|Fabrus\|V1-13_IGLJ5*01 | 1105 |
| 3459 VH3-23_IGHD6-13*01 > 1_IGHJ2*01 | 1300 | gnl\|Fabrus\|V1-13_IGLJ5*01 | 1105 |
| 3460 VH3-23_IGHD6-13*01 > 2_IGHJ2*01 | 1301 | gnl\|Fabrus\|V1-13_IGLJ5*01 | 1105 |
| 3461 VH3-23_IGHD6-19*01 > 1_IGHJ2*01 | 1302 | gnl\|Fabrus\|V1-13_IGLJ5*01 | 1105 |
| 3462 VH3-23_IGHD6-19*01 > 2_IGHJ2*01 | 1303 | gnl\|Fabrus\|V1-13_IGLJ5*01 | 1105 |
| 3463 VH3-23_IGHD6-25*01 > 1_IGHJ2*01 | 1304 | gnl\|Fabrus\|V1-13_IGLJ5*01 | 1105 |
| 3464 VH3-23_IGHD6-25*01 > 2_IGHJ2*01 | 1305 | gnl\|Fabrus\|V1-13_IGLJ5*01 | 1105 |
| 3465 VH3-23_IGHD7-27*01 > 1_IGHJ2*01 | 1306 | gnl\|Fabrus\|V1-13_IGLJ5*01 | 1105 |
| 3466 VH3-23_IGHD7-27*01 > 3_IGHJ2*01 | 1307 | gnl\|Fabrus\|V1-13_IGLJ5*01 | 1105 |
| 3467 VH3-23_IGHD6-13*01 > 1'_IGHJ2*01 | 1356 | gnl\|Fabrus\|V1-13_IGLJ5*01 | 1105 |
| 3468 VH3-23_IGHD6-13*01 > 2'_IGHJ2*01 | 1357 | gnl\|Fabrus\|V1-13_IGLJ5*01 | 1105 |
| 3469 VH3-23_IGHD6-13*01 > 2'_IGHJ2*01_B | 1358 | gnl\|Fabrus\|V1-13_IGLJ5*01 | 1105 |
| 3470 VH3-23_IGHD6-19*01 > 1'_IGHJ2*01 | 1359 | gnl\|Fabrus\|V1-13_IGLJ5*01 | 1105 |
| 3471 VH3-23_IGHD6-19*01 > 2'_IGHJ2*01 | 1360 | gnl\|Fabrus\|V1-13_IGLJ5*01 | 1105 |
| 3472 VH3-23_IGHD6-19*01 > 2'_IGHJ2*01_B | 1361 | gnl\|Fabrus\|V1-13_IGLJ5*01 | 1105 |
| 3473 VH3-23_IGHD6-25*01 > 1'_IGHJ2*01 | 1362 | gnl\|Fabrus\|V1-13_IGLJ5*01 | 1105 |
| 3474 VH3-23_IGHD6-25*01 > 3'_IGHJ2*01 | 1363 | gnl\|Fabrus\|V1-13_IGLJ5*01 | 1105 |
| 3475 VH3-23_IGHD7-27*01 > 1'_IGHJ2*01 | 1364 | gnl\|Fabrus\|V1-13_IGLJ5*01 | 1105 |
| 3476 VH3-23_IGHD7-27*01 > 2'_IGHJ2*01 | 1365 | gnl\|Fabrus\|V1-13_IGLJ5*01 | 1105 |
| 3477 VH3-23_IGHD6-6*01 > 2_IGHJ3*01 | 1414 | gnl\|Fabrus\|V1-13_IGLJ5*01 | 1105 |
| 3478 VH3-23_IGHD6-13*01 > 1_IGHJ3*01 | 1415 | gnl\|Fabrus\|V1-13_IGLJ5*01 | 1105 |
| 3479 VH3-23_IGHD6-13*01 > 2_IGHJ3*01 | 1416 | gnl\|Fabrus\|V1-13_IGLJ5*01 | 1105 |
| 3480 VH3-23_IGHD6-19*01 > 1_IGHJ3*01 | 1417 | gnl\|Fabrus\|V1-13_IGLJ5*01 | 1105 |
| 3481 VH3-23_IGHD6-19*01 > 2_IGHJ3*01 | 1418 | gnl\|Fabrus\|V1-13_IGLJ5*01 | 1105 |
| 3482 VH3-23_IGHD6-25*01 > 1_IGHJ3*01 | 1419 | gnl\|Fabrus\|V1-13_IGLJ5*01 | 1105 |
| 3483 VH3-23_IGHD6-25*01 > 2_IGHJ3*01 | 1420 | gnl\|Fabrus\|V1-13_IGLJ5*01 | 1105 |
| 3484 VH3-23_IGHD7-27*01 > 1_IGHJ3*01 | 1421 | gnl\|Fabrus\|V1-13_IGLJ5*01 | 1105 |
| 3485 VH3-23_IGHD7-27*01 > 3_IGHJ3*01 | 1422 | gnl\|Fabrus\|V1-13_IGLJ5*01 | 1105 |
| 3486 VH3-23_IGHD6-13*01 > 1'_IGHJ3*01 | 1471 | gnl\|Fabrus\|V1-13_IGLJ5*01 | 1105 |
| 3487 VH3-23_IGHD6-13*01 > 2'_IGHJ3*01 | 1472 | gnl\|Fabrus\|V1-13_IGLJ5*01 | 1105 |
| 3488 VH3-23_IGHD6-13*01 > 1_IGHJ6*01 | 1818 | gnl\|Fabrus\|V1-13_IGLJ5*01 | 1105 |
| 3489 VH3-23_IGHD6-19*01 > 1'_IGHJ3*01 | 1474 | gnl\|Fabrus\|V1-13_IGLJ5*01 | 1105 |
| 3490 VH3-23_IGHD6-19*01 > 2'_IGHJ3*01 | 1475 | gnl\|Fabrus\|V1-13_IGLJ5*01 | 1105 |
| 3491 VH3-23_IGHD6-19*01 > 3'_IGHJ3*01 | 1476 | gnl\|Fabrus\|V1-13_IGLJ5*01 | 1105 |
| 3492 VH3-23_IGHD6-25*01 > 1'_IGHJ3*01 | 1477 | gnl\|Fabrus\|V1-13_IGLJ5*01 | 1105 |
| 3493 VH3-23_IGHD6-25*01 > 3'_IGHJ3*01 | 1478 | gnl\|Fabrus\|V1-13_IGLJ5*01 | 1105 |
| 3494 VH3-23_IGHD7-27*01 > 1'_IGHJ3*01 | 1479 | gnl\|Fabrus\|V1-13_IGLJ5*01 | 1105 |
| 3495 VH3-23_IGHD7-27*01 > 2'_IGHJ3*01 | 1480 | gnl\|Fabrus\|V1-13_IGLJ5*01 | 1105 |

TABLE 4-continued

Exemplary Paired Nucleic Acid Library

| HEAVY CHAIN | SEQ ID NO | LIGHT CHAIN | SEQ ID NO |
|---|---|---|---|
| 3496 VH3-23_IGHD6-6*01 > 2_IGHJ4*01 | 1529 | gnl|Fabrus|V1-13_IGLJ5*01 | 1105 |
| 3497 VH3-23_IGHD6-13*01 > 1_IGHJ4*01 | 1530 | gnl|Fabrus|V1-13_IGLJ5*01 | 1105 |
| 3498 VH3-23_IGHD6-13*01 > 2_IGHJ4*01 | 1531 | gnl|Fabrus|V1-13_IGLJ5*01 | 1105 |
| 3499 VH3-23_IGHD6-19*01 > 1_IGHJ4*01 | 1532 | gnl|Fabrus|V1-13_IGLJ5*01 | 1105 |
| 3500 VH3-23_IGHD6-19*01 > 2_IGHJ4*01 | 1533 | gnl|Fabrus|V1-13_IGLJ5*01 | 1105 |
| 3501 VH3-23_IGHD6-25*01 > 1_IGHJ4*01 | 1534 | gnl|Fabrus|V1-13_IGLJ5*01 | 1105 |
| 3502 VH3-23_IGHD6-25*01 > 2_IGHJ4*01 | 1535 | gnl|Fabrus|V1-13_IGLJ5*01 | 1105 |
| 3503 VH3-23_IGHD7-27*01 > 1_IGHJ4*01 | 1536 | gnl|Fabrus|V1-13_IGLJ5*01 | 1105 |
| 3504 VH3-23_IGHD7-27*01 > 3_IGHJ4*01 | 1537 | gnl|Fabrus|V1-13_IGLJ5*01 | 1105 |
| 3505 VH3-23_IGHD6-13*01 > 1'_IGHJ4*01 | 1586 | gnl|Fabrus|V1-13_IGLJ5*01 | 1105 |
| 3506 VH3-23_IGHD6-13*01 > 2'_IGHJ4*01 | 1587 | gnl|Fabrus|V1-13_IGLJ5*01 | 1105 |
| 3507 VH3-23_IGHD6-13*01 > 2_IGHJ4*01_B | 1588 | gnl|Fabrus|V1-13_IGLJ5*01 | 1105 |
| 3508 VH3-23_IGHD6-19*01 > 1'_IGHJ4*01 | 1589 | gnl|Fabrus|V1-13_IGLJ5*01 | 1105 |
| 3509 VH3-23_IGHD6-19*01 > 2'_IGHJ4*01 | 1590 | gnl|Fabrus|V1-13_IGLJ5*01 | 1105 |
| 3510 VH3-23_IGHD6-19*01 > 2_IGHJ4*01_B | 1591 | gnl|Fabrus|V1-13_IGLJ5*01 | 1105 |
| 3511 VH3-23_IGHD6-25*01 > 1'_IGHJ4*01 | 1592 | gnl|Fabrus|V1-13_IGLJ5*01 | 1105 |
| 3512 VH3-23_IGHD6-25*01 > 3'_IGHJ4*01 | 1593 | gnl|Fabrus|V1-13_IGLJ5*01 | 1105 |
| 3513 VH3-23_IGHD7-27*01 > 1'_IGHJ4*01 | 1594 | gnl|Fabrus|V1-13_IGLJ5*01 | 1105 |
| 3514 VH3-23_IGHD7-27*01 > 2'_IGHJ4*01 | 1595 | gnl|Fabrus|V1-13_IGLJ5*01 | 1105 |
| 3515 VH3-23_IGHD6-6*01 > 2_IGHJ5*01 | 1644 | gnl|Fabrus|V1-13_IGLJ5*01 | 1105 |
| 3516 VH3-23_IGHD6-13*01 > 1_IGHJ5*01 | 1645 | gnl|Fabrus|V1-13_IGLJ5*01 | 1105 |
| 3517 VH3-23_IGHD6-13*01 > 2_IGHJ5*01 | 1646 | gnl|Fabrus|V1-13_IGLJ5*01 | 1105 |
| 3518 VH3-23_IGHD6-19*01 > 1_IGHJ5*01 | 1647 | gnl|Fabrus|V1-13_IGLJ5*01 | 1105 |
| 3519 VH3-23_IGHD6-19*01 > 2_IGHJ5*01 | 1648 | gnl|Fabrus|V1-13_IGLJ5*01 | 1105 |
| 3520 VH3-23_IGHD6-25*01 > 1_IGHJ5*01 | 1649 | gnl|Fabrus|V1-13_IGLJ5*01 | 1105 |
| 3521 VH3-23_IGHD6-25*01 > 2_IGHJ5*01 | 1650 | gnl|Fabrus|V1-13_IGLJ5*01 | 1105 |
| 3522 VH3-23_IGHD7-27*01 > 1_IGHJ5*01 | 1651 | gnl|Fabrus|V1-13_IGLJ5*01 | 1105 |
| 3523 VH3-23_IGHD7-27*01 > 3_IGHJ5*01 | 1652 | gnl|Fabrus|V1-13_IGLJ5*01 | 1105 |
| 3524 VH3-23_IGHD6-13*01 > 1'_IGHJ5*01 | 1701 | gnl|Fabrus|V1-13_IGLJ5*01 | 1105 |
| 3525 VH3-23_IGHD6-13*01 > 2'_IGHJ5*01 | 1702 | gnl|Fabrus|V1-13_IGLJ5*01 | 1105 |
| 3526 VH3-23_IGHD6-13*01 > 3'_IGHJ5*01 | 1703 | gnl|Fabrus|V1-13_IGLJ5*01 | 1105 |
| 3527 VH3-23_IGHD6-19*01 > 1'_IGHJ5*01 | 1704 | gnl|Fabrus|V1-13_IGLJ5*01 | 1105 |
| 3528 VH3-23_IGHD6-19*01 > 2'_IGHJ5*01 | 1705 | gnl|Fabrus|V1-13_IGLJ5*01 | 1105 |
| 3529 VH3-23_IGHD6-19*01 > 2_IGHJ5*01_B | 1706 | gnl|Fabrus|V1-13_IGLJ5*01 | 1105 |
| 3530 VH3-23_IGHD6-25*01 > 1'_IGHJ5*01 | 1707 | gnl|Fabrus|V1-13_IGLJ5*01 | 1105 |
| 3531 VH3-23_IGHD6-25*01 > 3'_IGHJ5*01 | 1708 | gnl|Fabrus|V1-13_IGLJ5*01 | 1105 |
| 3532 VH3-23_IGHD7-27*01 > 1'_IGHJ5*01 | 1709 | gnl|Fabrus|V1-13_IGLJ5*01 | 1105 |
| 3533 VH3-23_IGHD7-27*01 > 2'_IGHJ5*01 | 1710 | gnl|Fabrus|V1-13_IGLJ5*01 | 1105 |
| 3534 VH3-23_IGHD6-6*01 > 2_IGHJ6*01 | 1759 | gnl|Fabrus|V1-13_IGLJ5*01 | 1105 |
| 3535 VH3-23_IGHD6-6*01 > 2_IGHJ1*01 | 1184 | gnl|Fabrus|V1-16_IGLJ6*01 | 1106 |
| 3536 VH3-23_IGHD6-13*01 > 1_IGHJ1*01 | 1185 | gnl|Fabrus|V1-16_IGLJ6*01 | 1106 |
| 3537 VH3-23_IGHD6-13*01 > 2_IGHJ1*01 | 1186 | gnl|Fabrus|V1-16_IGLJ6*01 | 1106 |
| 3538 VH3-23_IGHD6-19*01 > 1_IGHJ1*01 | 1187 | gnl|Fabrus|V1-16_IGLJ6*01 | 1106 |
| 3539 VH3-23_IGHD6-19*01 > 2_IGHJ1*01 | 1188 | gnl|Fabrus|V1-16_IGLJ6*01 | 1106 |
| 3540 VH3-23_IGHD6-25*01 > 1_IGHJ1*01 | 1189 | gnl|Fabrus|V1-16_IGLJ6*01 | 1106 |
| 3541 VH3-23_IGHD6-25*01 > 2_IGHJ1*01 | 1190 | gnl|Fabrus|V1-16_IGLJ6*01 | 1106 |
| 3542 VH3-23_IGHD7-27*01 > 1_IGHJ1*01 | 1191 | gnl|Fabrus|V1-16_IGLJ6*01 | 1106 |
| 3543 VH3-23_IGHD7-27*01 > 3_IGHJ1*01 | 1192 | gnl|Fabrus|V1-16_IGLJ6*01 | 1106 |
| 3544 VH3-23_IGHD6-13*01 > 1'_IGHJ1*01 | 1241 | gnl|Fabrus|V1-16_IGLJ6*01 | 1106 |
| 3545 VH3-23_IGHD6-13*01 > 2'_IGHJ1*01 | 1242 | gnl|Fabrus|V1-16_IGLJ6*01 | 1106 |
| 3546 VH3-23_IGHD6-13*01 > 2_IGHJ1*01_B | 1243 | gnl|Fabrus|V1-16_IGLJ6*01 | 1106 |
| 3547 VH3-23_IGHD6-19*01 > 1'_IGHJ1*01 | 1244 | gnl|Fabrus|V1-16_IGLJ6*01 | 1106 |
| 3548 VH3-23_IGHD6-19*01 > 2'_IGHJ1*01 | 1245 | gnl|Fabrus|V1-16_IGLJ6*01 | 1106 |
| 3549 VH3-23_IGHD6-19*01 > 2_IGHJ1*01_B | 1246 | gnl|Fabrus|V1-16_IGLJ6*01 | 1106 |
| 3550 VH3-23_IGHD6-25*01 > 1'_IGHJ1*01 | 1247 | gnl|Fabrus|V1-16_IGLJ6*01 | 1106 |
| 3551 VH3-23_IGHD6-25*01 > 3'_IGHJ1*01 | 1248 | gnl|Fabrus|V1-16_IGLJ6*01 | 1106 |
| 3552 VH3-23_IGHD7-27*01 > 1'_IGHJ1*01_B | 1249 | gnl|Fabrus|V1-16_IGLJ6*01 | 1106 |
| 3553 VH3-23_IGHD7-27*01 > 2'_IGHJ1*01 | 1250 | gnl|Fabrus|V1-16_IGLJ6*01 | 1106 |
| 3554 VH3-23_IGHD6-6*01 > 2_IGHJ2*01 | 1299 | gnl|Fabrus|V1-16_IGLJ6*01 | 1106 |
| 3555 VH3-23_IGHD6-13*01 > 1_IGHJ2*01 | 1300 | gnl|Fabrus|V1-16_IGLJ6*01 | 1106 |
| 3556 VH3-23_IGHD6-13*01 > 2_IGHJ2*01 | 1301 | gnl|Fabrus|V1-16_IGLJ6*01 | 1106 |
| 3557 VH3-23_IGHD6-19*01 > 1_IGHJ2*01 | 1302 | gnl|Fabrus|V1-16_IGLJ6*01 | 1106 |
| 3558 VH3-23_IGHD6-19*01 > 2_IGHJ2*01 | 1303 | gnl|Fabrus|V1-16_IGLJ6*01 | 1106 |
| 3559 VH3-23_IGHD6-25*01 > 1_IGHJ2*01 | 1304 | gnl|Fabrus|V1-16_IGLJ6*01 | 1106 |
| 3560 VH3-23_IGHD6-25*01 > 2_IGHJ2*01 | 1305 | gnl|Fabrus|V1-16_IGLJ6*01 | 1106 |
| 3561 VH3-23_IGHD7-27*01 > 1_IGHJ2*01 | 1306 | gnl|Fabrus|V1-16_IGLJ6*01 | 1106 |
| 3562 VH3-23_IGHD7-27*01 > 3_IGHJ2*01 | 1307 | gnl|Fabrus|V1-16_IGLJ6*01 | 1106 |
| 3563 VH3-23_IGHD6-13*01 > 1'_IGHJ2*01 | 1356 | gnl|Fabrus|V1-16_IGLJ6*01 | 1106 |
| 3564 VH3-23_IGHD6-13*01 > 2'_IGHJ2*01 | 1357 | gnl|Fabrus|V1-16_IGLJ6*01 | 1106 |
| 3565 VH3-23_IGHD6-13*01 > 2_IGHJ2*01_B | 1358 | gnl|Fabrus|V1-16_IGLJ6*01 | 1106 |
| 3566 VH3-23_IGHD6-19*01 > 1'_IGHJ2*01 | 1359 | gnl|Fabrus|V1-16_IGLJ6*01 | 1106 |
| 3567 VH3-23_IGHD6-19*01 > 2'_IGHJ2*01 | 1360 | gnl|Fabrus|V1-16_IGLJ6*01 | 1106 |
| 3568 VH3-23_IGHD6-19*01 > 2_IGHJ2*01_B | 1361 | gnl|Fabrus|V1-16_IGLJ6*01 | 1106 |
| 3569 VH3-23_IGHD6-25*01 > 1'_IGHJ2*01 | 1362 | gnl|Fabrus|V1-16_IGLJ6*01 | 1106 |

TABLE 4-continued

Exemplary Paired Nucleic Acid Library

| HEAVY CHAIN | SEQ ID NO | LIGHT CHAIN | SEQ ID NO |
|---|---|---|---|
| 3570 VH3-23_IGHD6-25*01 > 3'_IGHJ2*01 | 1363 | gnl|Fabrus|V1-16_IGLJ6*01 | 1106 |
| 3571 VH3-23_IGHD7-27*01 > 1'_IGHJ2*01 | 1364 | gnl|Fabrus|V1-16_IGLJ6*01 | 1106 |
| 3572 VH3-23_IGHD7-27*01 > 2'_IGHJ2*01 | 1365 | gnl|Fabrus|V1-16_IGLJ6*01 | 1106 |
| 3573 VH3-23_IGHD6-6*01 > 2_IGHJ3*01 | 1414 | gnl|Fabrus|V1-16_IGLJ6*01 | 1106 |
| 3574 VH3-23_IGHD6-13*01 > 1_IGHJ3*01 | 1415 | gnl|Fabrus|V1-16_IGLJ6*01 | 1106 |
| 3575 VH3-23_IGHD6-13*01 > 2_IGHJ3*01 | 1416 | gnl|Fabrus|V1-16_IGLJ6*01 | 1106 |
| 3576 VH3-23_IGHD6-19*01 > 1_IGHJ3*01 | 1417 | gnl|Fabrus|V1-16_IGLJ6*01 | 1106 |
| 3577 VH3-23_IGHD6-19*01 > 2_IGHJ3*01 | 1418 | gnl|Fabrus|V1-16_IGLJ6*01 | 1106 |
| 3578 VH3-23_IGHD6-25*01 > 1_IGHJ3*01 | 1419 | gnl|Fabrus|V1-16_IGLJ6*01 | 1106 |
| 3579 VH3-23_IGHD6-25*01 > 2_IGHJ3*01 | 1420 | gnl|Fabrus|V1-16_IGLJ6*01 | 1106 |
| 3580 VH3-23_IGHD7-27*01 > 1_IGHJ3*01 | 1421 | gnl|Fabrus|V1-16_IGLJ6*01 | 1106 |
| 3581 VH3-23_IGHD7-27*01 > 3_IGHJ3*01 | 1422 | gnl|Fabrus|V1-16_IGLJ6*01 | 1106 |
| 3582 VH3-23_IGHD6-13*01 > 1'_IGHJ3*01 | 1471 | gnl|Fabrus|V1-16_IGLJ6*01 | 1106 |
| 3583 VH3-23_IGHD6-13*01 > 2'_IGHJ3*01 | 1472 | gnl|Fabrus|V1-16_IGLJ6*01 | 1106 |
| 3584 VH3-23_IGHD6-13*01 > 1_IGHJ6*01 | 1818 | gnl|Fabrus|V1-16_IGLJ6*01 | 1106 |
| 3585 VH3-23_IGHD6-19*01 > 1'_IGHJ3*01 | 1474 | gnl|Fabrus|V1-16_IGLJ6*01 | 1106 |
| 3586 VH3-23_IGHD6-19*01 > 2'_IGHJ3*01 | 1475 | gnl|Fabrus|V1-16_IGLJ6*01 | 1106 |
| 3587 VH3-23_IGHD6-19*01 > 3'_IGHJ3*01 | 1476 | gnl|Fabrus|V1-16_IGLJ6*01 | 1106 |
| 3588 VH3-23_IGHD6-25*01 > 1'_IGHJ3*01 | 1477 | gnl|Fabrus|V1-16_IGLJ6*01 | 1106 |
| 3589 VH3-23_IGHD6-25*01 > 3'_IGHJ3*01 | 1478 | gnl|Fabrus|V1-16_IGLJ6*01 | 1106 |
| 3590 VH3-23_IGHD7-27*01 > 1'_IGHJ3*01 | 1479 | gnl|Fabrus|V1-16_IGLJ6*01 | 1106 |
| 3591 VH3-23_IGHD7-27*01 > 2'_IGHJ3*01 | 1480 | gnl|Fabrus|V1-16_IGLJ6*01 | 1106 |
| 3592 VH3-23_IGHD6-6*01 > 2_IGHJ4*01 | 1529 | gnl|Fabrus|V1-16_IGLJ6*01 | 1106 |
| 3593 VH3-23_IGHD6-13*01 > 1_IGHJ4*01 | 1530 | gnl|Fabrus|V1-16_IGLJ6*01 | 1106 |
| 3594 VH3-23_IGHD6-13*01 > 2_IGHJ4*01 | 1531 | gnl|Fabrus|V1-16_IGLJ6*01 | 1106 |
| 3595 VH3-23_IGHD6-19*01 > 1_IGHJ4*01 | 1532 | gnl|Fabrus|V1-16_IGLJ6*01 | 1106 |
| 3596 VH3-23_IGHD6-19*01 > 2_IGHJ4*01 | 1533 | gnl|Fabrus|V1-16_IGLJ6*01 | 1106 |
| 3597 VH3-23_IGHD6-25*01 > 1_IGHJ4*01 | 1534 | gnl|Fabrus|V1-16_IGLJ6*01 | 1106 |
| 3598 VH3-23_IGHD6-25*01 > 2_IGHJ4*01 | 1535 | gnl|Fabrus|V1-16_IGLJ6*01 | 1106 |
| 3599 VH3-23_IGHD7-27*01 > 1_IGHJ4*01 | 1536 | gnl|Fabrus|V1-16_IGLJ6*01 | 1106 |
| 3600 VH3-23_IGHD7-27*01 > 3_IGHJ4*01 | 1537 | gnl|Fabrus|V1-16_IGLJ6*01 | 1106 |
| 3601 VH3-23_IGHD6-13*01 > 1'_IGHJ4*01 | 1586 | gnl|Fabrus|V1-16_IGLJ6*01 | 1106 |
| 3602 VH3-23_IGHD6-13*01 > 2'_IGHJ4*01 | 1587 | gnl|Fabrus|V1-16_IGLJ6*01 | 1106 |
| 3603 VH3-23_IGHD6-13*01 > 2_IGHJ4*01_B | 1588 | gnl|Fabrus|V1-16_IGLJ6*01 | 1106 |
| 3604 VH3-23_IGHD6-19*01 > 1'_IGHJ4*01 | 1589 | gnl|Fabrus|V1-16_IGLJ6*01 | 1106 |
| 3605 VH3-23_IGHD6-19*01 > 2'_IGHJ4*01 | 1590 | gnl|Fabrus|V1-16_IGLJ6*01 | 1106 |
| 3606 VH3-23_IGHD6-19*01 > 2_IGHJ4*01_B | 1591 | gnl|Fabrus|V1-16_IGLJ6*01 | 1106 |
| 3607 VH3-23_IGHD6-25*01 > 1'_IGHJ4*01 | 1592 | gnl|Fabrus|V1-16_IGLJ6*01 | 1106 |
| 3608 VH3-23_IGHD6-25*01 > 3'_IGHJ4*01 | 1593 | gnl|Fabrus|V1-16_IGLJ6*01 | 1106 |
| 3609 VH3-23_IGHD7-27*01 > 1'_IGHJ4*01 | 1594 | gnl|Fabrus|V1-16_IGLJ6*01 | 1106 |
| 3610 VH3-23_IGHD7-27*01 > 2'_IGHJ4*01 | 1595 | gnl|Fabrus|V1-16_IGLJ6*01 | 1106 |
| 3611 VH3-23_IGHD6-6*01 > 2_IGHJ5*01 | 1644 | gnl|Fabrus|V1-16_IGLJ6*01 | 1106 |
| 3612 VH3-23_IGHD6-13*01 > 1_IGHJ5*01 | 1645 | gnl|Fabrus|V1-16_IGLJ6*01 | 1106 |
| 3613 VH3-23_IGHD6-13*01 > 2_IGHJ5*01 | 1646 | gnl|Fabrus|V1-16_IGLJ6*01 | 1106 |
| 3614 VH3-23_IGHD6-19*01 > 1_IGHJ5*01 | 1647 | gnl|Fabrus|V1-16_IGLJ6*01 | 1106 |
| 3615 VH3-23_IGHD6-19*01 > 2_IGHJ5*01 | 1648 | gnl|Fabrus|V1-16_IGLJ6*01 | 1106 |
| 3616 VH3-23_IGHD6-25*01 > 1_IGHJ5*01 | 1649 | gnl|Fabrus|V1-16_IGLJ6*01 | 1106 |
| 3617 VH3-23_IGHD6-25*01 > 2_IGHJ5*01 | 1650 | gnl|Fabrus|V1-16_IGLJ6*01 | 1106 |
| 3618 VH3-23_IGHD7-27*01 > 1_IGHJ5*01 | 1651 | gnl|Fabrus|V1-16_IGLJ6*01 | 1106 |
| 3619 VH3-23_IGHD7-27*01 > 3_IGHJ5*01 | 1652 | gnl|Fabrus|V1-16_IGLJ6*01 | 1106 |
| 3620 VH3-23_IGHD6-13*01 > 1'_IGHJ5*01 | 1701 | gnl|Fabrus|V1-16_IGLJ6*01 | 1106 |
| 3621 VH3-23_IGHD6-13*01 > 2'_IGHJ5*01 | 1702 | gnl|Fabrus|V1-16_IGLJ6*01 | 1106 |
| 3622 VH3-23_IGHD6-13*01 > 3'_IGHJ5*01 | 1703 | gnl|Fabrus|V1-16_IGLJ6*01 | 1106 |
| 3623 VH3-23_IGHD6-19*01 > 1'_IGHJ5*01 | 1704 | gnl|Fabrus|V1-16_IGLJ6*01 | 1106 |
| 3624 VH3-23_IGHD6-19*01 > 2'_IGHJ5*01 | 1705 | gnl|Fabrus|V1-16_IGLJ6*01 | 1106 |
| 3625 VH3-23_IGHD6-19*01 > 2_IGHJ5*01_B | 1706 | gnl|Fabrus|V1-16_IGLJ6*01 | 1106 |
| 3626 VH3-23_IGHD6-25*01 > 1'_IGHJ5*01 | 1707 | gnl|Fabrus|V1-16_IGLJ6*01 | 1106 |
| 3627 VH3-23_IGHD6-25*01 > 3'_IGHJ5*01 | 1708 | gnl|Fabrus|V1-16_IGLJ6*01 | 1106 |
| 3628 VH3-23_IGHD7-27*01 > 1'_IGHJ5*01 | 1709 | gnl|Fabrus|V1-16_IGLJ6*01 | 1106 |
| 3629 VH3-23_IGHD7-27*01 > 2'_IGHJ5*01 | 1710 | gnl|Fabrus|V1-16_IGLJ6*01 | 1106 |
| 3630 VH3-23_IGHD6-6*01 > 2_IGHJ6*01 | 1759 | gnl|Fabrus|V1-16_IGLJ6*01 | 1106 |
| 3631 VH3-23_IGHD6-6*01 > 2_IGHJ1*01 | 1184 | gnl|Fabrus|V1-2_IGLJ7*01 | 1108 |
| 3632 VH3-23_IGHD6-13*01 > 1_IGHJ1*01 | 1185 | gnl|Fabrus|V1-2_IGLJ7*01 | 1108 |
| 3633 VH3-23_IGHD6-13*01 > 2_IGHJ1*01 | 1186 | gnl|Fabrus|V1-2_IGLJ7*01 | 1108 |
| 3634 VH3-23_IGHD6-19*01 > 1_IGHJ1*01 | 1187 | gnl|Fabrus|V1-2_IGLJ7*01 | 1108 |
| 3635 VH3-23_IGHD6-19*01 > 2_IGHJ1*01 | 1188 | gnl|Fabrus|V1-2_IGLJ7*01 | 1108 |
| 3636 VH3-23_IGHD6-25*01 > 1_IGHJ1*01 | 1189 | gnl|Fabrus|V1-2_IGLJ7*01 | 1108 |
| 3637 VH3-23_IGHD6-25*01 > 2_IGHJ1*01 | 1190 | gnl|Fabrus|V1-2_IGLJ7*01 | 1108 |
| 3638 VH3-23_IGHD7-27*01 > 1_IGHJ1*01 | 1191 | gnl|Fabrus|V1-2_IGLJ7*01 | 1108 |
| 3639 VH3-23_IGHD7-27*01 > 3_IGHJ1*01 | 1192 | gnl|Fabrus|V1-2_IGLJ7*01 | 1108 |
| 3640 VH3-23_IGHD6-13*01 > 1'_IGHJ1*01 | 1241 | gnl|Fabrus|V1-2_IGLJ7*01 | 1108 |
| 3641 VH3-23_IGHD6-13*01 > 2'_IGHJ1*01 | 1242 | gnl|Fabrus|V1-2_IGLJ7*01 | 1108 |
| 3642 VH3-23_IGHD6-13*01 > 2_IGHJ1*01_B | 1243 | gnl|Fabrus|V1-2_IGLJ7*01 | 1108 |
| 3643 VH3-23_IGHD6-19*01 > 1'_IGHJ1*01 | 1244 | gnl|Fabrus|V1-2_IGLJ7*01 | 1108 |

TABLE 4-continued

Exemplary Paired Nucleic Acid Library

| HEAVY CHAIN | SEQ ID NO | LIGHT CHAIN | SEQ ID NO |
|---|---|---|---|
| 3644 VH3-23_IGHD6-19*01 > 2'_IGHJ1*01 | 1245 | gnl|Fabrus|V1-2_IGLJ7*01 | 1108 |
| 3645 VH3-23_IGHD6-19*01 > 2_IGHJ1*01_B | 1246 | gnl|Fabrus|V1-2_IGLJ7*01 | 1108 |
| 3646 VH3-23_IGHD6-25*01 > 1'_IGHJ1*01 | 1247 | gnl|Fabrus|V1-2_IGLJ7*01 | 1108 |
| 3647 VH3-23_IGHD6-25*01 > 3'_IGHJ1*01 | 1248 | gnl|Fabrus|V1-2_IGLJ7*01 | 1108 |
| 3648 VH3-23_IGHD7-27*01 > 1'_IGHJ1*01_B | 1249 | gnl|Fabrus|V1-2_IGLJ7*01 | 1108 |
| 3649 VH3-23_IGHD7-27*01 > 2'_IGHJ1*01 | 1250 | gnl|Fabrus|V1-2_IGLJ7*01 | 1108 |
| 3650 VH3-23_IGHD6-6*01 > 2_IGHJ2*01 | 1299 | gnl|Fabrus|V1-2_IGLJ7*01 | 1108 |
| 3651 VH3-23_IGHD6-13*01 > 1_IGHJ2*01 | 1300 | gnl|Fabrus|V1-2_IGLJ7*01 | 1108 |
| 3652 VH3-23_IGHD6-13*01 > 2_IGHJ2*01 | 1301 | gnl|Fabrus|V1-2_IGLJ7*01 | 1108 |
| 3653 VH3-23_IGHD6-19*01 > 1_IGHJ2*01 | 1302 | gnl|Fabrus|V1-2_IGLJ7*01 | 1108 |
| 3654 VH3-23_IGHD6-19*01 > 2_IGHJ2*01 | 1303 | gnl|Fabrus|V1-2_IGLJ7*01 | 1108 |
| 3655 VH3-23_IGHD6-25*01 > 1_IGHJ2*01 | 1304 | gnl|Fabrus|V1-2_IGLJ7*01 | 1108 |
| 3656 VH3-23_IGHD6-25*01 > 2_IGHJ2*01 | 1305 | gnl|Fabrus|V1-2_IGLJ7*01 | 1108 |
| 3657 VH3-23_IGHD7-27*01 > 1_IGHJ2*01 | 1306 | gnl|Fabrus|V1-2_IGLJ7*01 | 1108 |
| 3658 VH3-23_IGHD7-27*01 > 3_IGHJ2*01 | 1307 | gnl|Fabrus|V1-2_IGLJ7*01 | 1108 |
| 3659 VH3-23_IGHD6-13*01 > 1'_IGHJ2*01 | 1356 | gnl|Fabrus|V1-2_IGLJ7*01 | 1108 |
| 3660 VH3-23_IGHD6-13*01 > 2'_IGHJ2*01 | 1357 | gnl|Fabrus|V1-2_IGLJ7*01 | 1108 |
| 3661 VH3-23_IGHD6-13*01 > 2_IGHJ2*01_B | 1358 | gnl|Fabrus|V1-2_IGLJ7*01 | 1108 |
| 3662 VH3-23_IGHD6-19*01 > 1'_IGHJ2*01 | 1359 | gnl|Fabrus|V1-2_IGLJ7*01 | 1108 |
| 3663 VH3-23_IGHD6-19*01 > 2'_IGHJ2*01 | 1360 | gnl|Fabrus|V1-2_IGLJ7*01 | 1108 |
| 3664 VH3-23_IGHD6-19*01 > 2_IGHJ2*01_B | 1361 | gnl|Fabrus|V1-2_IGLJ7*01 | 1108 |
| 3665 VH3-23_IGHD6-25*01 > 1'_IGHJ2*01 | 1362 | gnl|Fabrus|V1-2_IGLJ7*01 | 1108 |
| 3666 VH3-23_IGHD6-25*01 > 3'_IGHJ2*01 | 1363 | gnl|Fabrus|V1-2_IGLJ7*01 | 1108 |
| 3667 VH3-23_IGHD7-27*01 > 1'_IGHJ2*01 | 1364 | gnl|Fabrus|V1-2_IGLJ7*01 | 1108 |
| 3668 VH3-23_IGHD7-27*01 > 2'_IGHJ2*01 | 1365 | gnl|Fabrus|V1-2_IGLJ7*01 | 1108 |
| 3669 VH3-23_IGHD6-6*01 > 2_IGHJ3*01 | 1414 | gnl|Fabrus|V1-2_IGLJ7*01 | 1108 |
| 3670 VH3-23_IGHD6-13*01 > 1_IGHJ3*01 | 1415 | gnl|Fabrus|V1-2_IGLJ7*01 | 1108 |
| 3671 VH3-23_IGHD6-13*01 > 2_IGHJ3*01 | 1416 | gnl|Fabrus|V1-2_IGLJ7*01 | 1108 |
| 3672 VH3-23_IGHD6-19*01 > 1_IGHJ3*01 | 1417 | gnl|Fabrus|V1-2_IGLJ7*01 | 1108 |
| 3673 VH3-23_IGHD6-19*01 > 2_IGHJ3*01 | 1418 | gnl|Fabrus|V1-2_IGLJ7*01 | 1108 |
| 3674 VH3-23_IGHD6-25*01 > 1_IGHJ3*01 | 1419 | gnl|Fabrus|V1-2_IGLJ7*01 | 1108 |
| 3675 VH3-23_IGHD6-25*01 > 2_IGHJ3*01 | 1420 | gnl|Fabrus|V1-2_IGLJ7*01 | 1108 |
| 3676 VH3-23_IGHD7-27*01 > 1_IGHJ3*01 | 1421 | gnl|Fabrus|V1-2_IGLJ7*01 | 1108 |
| 3677 VH3-23_IGHD7-27*01 > 3_IGHJ3*01 | 1422 | gnl|Fabrus|V1-2_IGLJ7*01 | 1108 |
| 3678 VH3-23_IGHD6-13*01 > 1'_IGHJ3*01 | 1471 | gnl|Fabrus|V1-2_IGLJ7*01 | 1108 |
| 3679 VH3-23_IGHD6-13*01 > 2'_IGHJ3*01 | 1472 | gnl|Fabrus|V1-2_IGLJ7*01 | 1108 |
| 3680 VH3-23_IGHD6-13*01 > 1_IGHJ6*01 | 1818 | gnl|Fabrus|V1-2_IGLJ7*01 | 1108 |
| 3681 VH3-23_IGHD6-19*01 > 1'_IGHJ3*01 | 1474 | gnl|Fabrus|V1-2_IGLJ7*01 | 1108 |
| 3682 VH3-23_IGHD6-19*01 > 2'_IGHJ3*01 | 1475 | gnl|Fabrus|V1-2_IGLJ7*01 | 1108 |
| 3683 VH3-23_IGHD6-19*01 > 3'_IGHJ3*01 | 1476 | gnl|Fabrus|V1-2_IGLJ7*01 | 1108 |
| 3684 VH3-23_IGHD6-25*01 > 1'_IGHJ3*01 | 1477 | gnl|Fabrus|V1-2_IGLJ7*01 | 1108 |
| 3685 VH3-23_IGHD6-25*01 > 3'_IGHJ3*01 | 1478 | gnl|Fabrus|V1-2_IGLJ7*01 | 1108 |
| 3686 VH3-23_IGHD7-27*01 > 1'_IGHJ3*01 | 1479 | gnl|Fabrus|V1-2_IGLJ7*01 | 1108 |
| 3687 VH3-23_IGHD7-27*01 > 2'_IGHJ3*01 | 1480 | gnl|Fabrus|V1-2_IGLJ7*01 | 1108 |
| 3688 VH3-23_IGHD6-6*01 > 2_IGHJ4*01 | 1529 | gnl|Fabrus|V1-2_IGLJ7*01 | 1108 |
| 3689 VH3-23_IGHD6-13*01 > 1_IGHJ4*01 | 1530 | gnl|Fabrus|V1-2_IGLJ7*01 | 1108 |
| 3690 VH3-23_IGHD6-13*01 > 2_IGHJ4*01 | 1531 | gnl|Fabrus|V1-2_IGLJ7*01 | 1108 |
| 3691 VH3-23_IGHD6-19*01 > 1_IGHJ4*01 | 1532 | gnl|Fabrus|V1-2_IGLJ7*01 | 1108 |
| 3692 VH3-23_IGHD6-19*01 > 2_IGHJ4*01 | 1533 | gnl|Fabrus|V1-2_IGLJ7*01 | 1108 |
| 3693 VH3-23_IGHD6-25*01 > 1_IGHJ4*01 | 1534 | gnl|Fabrus|V1-2_IGLJ7*01 | 1108 |
| 3694 VH3-23_IGHD6-25*01 > 2_IGHJ4*01 | 1535 | gnl|Fabrus|V1-2_IGLJ7*01 | 1108 |
| 3695 VH3-23_IGHD7-27*01 > 1_IGHJ4*01 | 1536 | gnl|Fabrus|V1-2_IGLJ7*01 | 1108 |
| 3696 VH3-23_IGHD7-27*01 > 3_IGHJ4*01 | 1537 | gnl|Fabrus|V1-2_IGLJ7*01 | 1108 |
| 3697 VH3-23_IGHD6-13*01 > 1'_IGHJ4*01 | 1586 | gnl|Fabrus|V1-2_IGLJ7*01 | 1108 |
| 3698 VH3-23_IGHD6-13*01 > 2'_IGHJ4*01 | 1587 | gnl|Fabrus|V1-2_IGLJ7*01 | 1108 |
| 3699 VH3-23_IGHD6-13*01 > 2_IGHJ4*01_B | 1588 | gnl|Fabrus|V1-2_IGLJ7*01 | 1108 |
| 3700 VH3-23_IGHD6-19*01 > 1'_IGHJ4*01 | 1589 | gnl|Fabrus|V1-2_IGLJ7*01 | 1108 |
| 3701 VH3-23_IGHD6-19*01 > 2'_IGHJ4*01 | 1590 | gnl|Fabrus|V1-2_IGLJ7*01 | 1108 |
| 3702 VH3-23_IGHD6-19*01 > 2_IGHJ4*01_B | 1591 | gnl|Fabrus|V1-2_IGLJ7*01 | 1108 |
| 3703 VH3-23_IGHD6-25*01 > 1'_IGHJ4*01 | 1592 | gnl|Fabrus|V1-2_IGLJ7*01 | 1108 |
| 3704 VH3-23_IGHD6-25*01 > 3'_IGHJ4*01 | 1593 | gnl|Fabrus|V1-2_IGLJ7*01 | 1108 |
| 3705 VH3-23_IGHD7-27*01 > 1'_IGHJ4*01 | 1594 | gnl|Fabrus|V1-2_IGLJ7*01 | 1108 |
| 3706 VH3-23_IGHD7-27*01 > 2'_IGHJ4*01 | 1595 | gnl|Fabrus|V1-2_IGLJ7*01 | 1108 |
| 3707 VH3-23_IGHD6-6*01 > 2_IGHJ5*01 | 1644 | gnl|Fabrus|V1-2_IGLJ7*01 | 1108 |
| 3708 VH3-23_IGHD6-13*01 > 1_IGHJ5*01 | 1645 | gnl|Fabrus|V1-2_IGLJ7*01 | 1108 |
| 3709 VH3-23_IGHD6-13*01 > 2_IGHJ5*01 | 1646 | gnl|Fabrus|V1-2_IGLJ7*01 | 1108 |
| 3710 VH3-23_IGHD6-19*01 > 1_IGHJ5*01 | 1647 | gnl|Fabrus|V1-2_IGLJ7*01 | 1108 |
| 3711 VH3-23_IGHD6-19*01 > 2_IGHJ5*01 | 1648 | gnl|Fabrus|V1-2_IGLJ7*01 | 1108 |
| 3712 VH3-23_IGHD6-25*01 > 1_IGHJ5*01 | 1649 | gnl|Fabrus|V1-2_IGLJ7*01 | 1108 |
| 3713 VH3-23_IGHD6-25*01 > 2_IGHJ5*01 | 1650 | gnl|Fabrus|V1-2_IGLJ7*01 | 1108 |
| 3714 VH3-23_IGHD7-27*01 > 1_IGHJ5*01 | 1651 | gnl|Fabrus|V1-2_IGLJ7*01 | 1108 |
| 3715 VH3-23_IGHD7-27*01 > 3_IGHJ5*01 | 1652 | gnl|Fabrus|V1-2_IGLJ7*01 | 1108 |
| 3716 VH3-23_IGHD6-13*01 > 1'_IGHJ5*01 | 1701 | gnl|Fabrus|V1-2_IGLJ7*01 | 1108 |
| 3717 VH3-23_IGHD6-13*01 > 2'_IGHJ5*01 | 1702 | gnl|Fabrus|V1-2_IGLJ7*01 | 1108 |

TABLE 4-continued

Exemplary Paired Nucleic Acid Library

| HEAVY CHAIN | SEQ ID NO | LIGHT CHAIN | SEQ ID NO |
|---|---|---|---|
| 3718 VH3-23_IGHD6-13*01 > 3'_IGHJ5*01 | 1703 | gnl|Fabrus|V1-2_IGLJ7*01 | 1108 |
| 3719 VH3-23_IGHD6-19*01 > 1'_IGHJ5*01 | 1704 | gnl|Fabrus|V1-2_IGLJ7*01 | 1108 |
| 3720 VH3-23_IGHD6-19*01 > 2'_IGHJ5*01 | 1705 | gnl|Fabrus|V1-2_IGLJ7*01 | 1108 |
| 3721 VH3-23_IGHD6-19*01 > 2_IGHJ5*01_B | 1706 | gnl|Fabrus|V1-2_IGLJ7*01 | 1108 |
| 3722 VH3-23_IGHD6-25*01 > 1'_IGHJ5*01 | 1707 | gnl|Fabrus|V1-2_IGLJ7*01 | 1108 |
| 3723 VH3-23_IGHD6-25*01 > 3'_IGHJ5*01 | 1708 | gnl|Fabrus|V1-2_IGLJ7*01 | 1108 |
| 3724 VH3-23_IGHD7-27*01 > 1'_IGHJ5*01 | 1709 | gnl|Fabrus|V1-2_IGLJ7*01 | 1108 |
| 3725 VH3-23_IGHD7-27*01 > 2'_IGHJ5*01 | 1710 | gnl|Fabrus|V1-2_IGLJ7*01 | 1108 |
| 3726 VH3-23_IGHD6-6*01 > 2_IGHJ6*01 | 1759 | gnl|Fabrus|V1-2_IGLJ7*01 | 1108 |
| 3727 VH3-23_IGHD6-6*01 > 2_IGHJ1*01 | 1184 | gnl|Fabrus|V1-20_IGLJ6*01 | 1109 |
| 3728 VH3-23_IGHD6-13*01 > 1_IGHJ1*01 | 1185 | gnl|Fabrus|V1-20_IGLJ6*01 | 1109 |
| 3729 VH3-23_IGHD6-13*01 > 2_IGHJ1*01 | 1186 | gnl|Fabrus|V1-20_IGLJ6*01 | 1109 |
| 3730 VH3-23_IGHD6-19*01 > 1_IGHJ1*01 | 1187 | gnl|Fabrus|V1-20_IGLJ6*01 | 1109 |
| 3731 VH3-23_IGHD6-19*01 > 2_IGHJ1*01 | 1188 | gnl|Fabrus|V1-20_IGLJ6*01 | 1109 |
| 3732 VH3-23_IGHD6-25*01 > 1_IGHJ1*01 | 1189 | gnl|Fabrus|V1-20_IGLJ6*01 | 1109 |
| 3733 VH3-23_IGHD6-25*01 > 2_IGHJ1*01 | 1190 | gnl|Fabrus|V1-20_IGLJ6*01 | 1109 |
| 3734 VH3-23_IGHD7-27*01 > 1_IGHJ1*01 | 1191 | gnl|Fabrus|V1-20_IGLJ6*01 | 1109 |
| 3735 VH3-23_IGHD7-27*01 > 3_IGHJ1*01 | 1192 | gnl|Fabrus|V1-20_IGLJ6*01 | 1109 |
| 3736 VH3-23_IGHD6-13*01 > 1'_IGHJ1*01 | 1241 | gnl|Fabrus|V1-20_IGLJ6*01 | 1109 |
| 3737 VH3-23_IGHD6-13*01 > 2'_IGHJ1*01 | 1242 | gnl|Fabrus|V1-20_IGLJ6*01 | 1109 |
| 3738 VH3-23_IGHD6-13*01 > 2_IGHJ1*01_B | 1243 | gnl|Fabrus|V1-20_IGLJ6*01 | 1109 |
| 3739 VH3-23_IGHD6-19*01 > 1'_IGHJ1*01 | 1244 | gnl|Fabrus|V1-20_IGLJ6*01 | 1109 |
| 3740 VH3-23_IGHD6-19*01 > 2'_IGHJ1*01 | 1245 | gnl|Fabrus|V1-20_IGLJ6*01 | 1109 |
| 3741 VH3-23_IGHD6-19*01 > 2_IGHJ1*01_B | 1246 | gnl|Fabrus|V1-20_IGLJ6*01 | 1109 |
| 3742 VH3-23_IGHD6-25*01 > 1'_IGHJ1*01 | 1247 | gnl|Fabrus|V1-20_IGLJ6*01 | 1109 |
| 3743 VH3-23_IGHD6-25*01 > 3'_IGHJ1*01 | 1248 | gnl|Fabrus|V1-20_IGLJ6*01 | 1109 |
| 3744 VH3-23_IGHD7-27*01 > 1'_IGHJ1*01_B | 1249 | gnl|Fabrus|V1-20_IGLJ6*01 | 1109 |
| 3745 VH3-23_IGHD7-27*01 > 2'_IGHJ1*01 | 1250 | gnl|Fabrus|V1-20_IGLJ6*01 | 1109 |
| 3746 VH3-23_IGHD6-6*01 > 2_IGHJ2*01 | 1299 | gnl|Fabrus|V1-20_IGLJ6*01 | 1109 |
| 3747 VH3-23_IGHD6-13*01 > 1_IGHJ2*01 | 1300 | gnl|Fabrus|V1-20_IGLJ6*01 | 1109 |
| 3748 VH3-23_IGHD6-13*01 > 2_IGHJ2*01 | 1301 | gnl|Fabrus|V1-20_IGLJ6*01 | 1109 |
| 3749 VH3-23_IGHD6-19*01 > 1_IGHJ2*01 | 1302 | gnl|Fabrus|V1-20_IGLJ6*01 | 1109 |
| 3750 VH3-23_IGHD6-19*01 > 2_IGHJ2*01 | 1303 | gnl|Fabrus|V1-20_IGLJ6*01 | 1109 |
| 3751 VH3-23_IGHD6-25*01 > 1_IGHJ2*01 | 1304 | gnl|Fabrus|V1-20_IGLJ6*01 | 1109 |
| 3752 VH3-23_IGHD6-25*01 > 2_IGHJ2*01 | 1305 | gnl|Fabrus|V1-20_IGLJ6*01 | 1109 |
| 3753 VH3-23_IGHD7-27*01 > 1_IGHJ2*01 | 1306 | gnl|Fabrus|V1-20_IGLJ6*01 | 1109 |
| 3754 VH3-23_IGHD7-27*01 > 3_IGHJ2*01 | 1307 | gnl|Fabrus|V1-20_IGLJ6*01 | 1109 |
| 3755 VH3-23_IGHD6-13*01 > 1'_IGHJ2*01 | 1356 | gnl|Fabrus|V1-20_IGLJ6*01 | 1109 |
| 3756 VH3-23_IGHD6-13*01 > 2'_IGHJ2*01 | 1357 | gnl|Fabrus|V1-20_IGLJ6*01 | 1109 |
| 3757 VH3-23_IGHD6-13*01 > 2_IGHJ2*01_B | 1358 | gnl|Fabrus|V1-20_IGLJ6*01 | 1109 |
| 3758 VH3-23_IGHD6-19*01 > 1'_IGHJ2*01 | 1359 | gnl|Fabrus|V1-20_IGLJ6*01 | 1109 |
| 3759 VH3-23_IGHD6-19*01 > 2'_IGHJ2*01 | 1360 | gnl|Fabrus|V1-20_IGLJ6*01 | 1109 |
| 3760 VH3-23_IGHD6-19*01 > 2_IGHJ2*01_B | 1361 | gnl|Fabrus|V1-20_IGLJ6*01 | 1109 |
| 3761 VH3-23_IGHD6-25*01 > 1'_IGHJ2*01 | 1362 | gnl|Fabrus|V1-20_IGLJ6*01 | 1109 |
| 3762 VH3-23_IGHD6-25*01 > 3'_IGHJ2*01 | 1363 | gnl|Fabrus|V1-20_IGLJ6*01 | 1109 |
| 3763 VH3-23_IGHD7-27*01 > 1'_IGHJ2*01 | 1364 | gnl|Fabrus|V1-20_IGLJ6*01 | 1109 |
| 3764 VH3-23_IGHD7-27*01 > 2'_IGHJ2*01 | 1365 | gnl|Fabrus|V1-20_IGLJ6*01 | 1109 |
| 3765 VH3-23_IGHD6-6*01 > 2_IGHJ3*01 | 1414 | gnl|Fabrus|V1-20_IGLJ6*01 | 1109 |
| 3766 VH3-23_IGHD6-13*01 > 1_IGHJ3*01 | 1415 | gnl|Fabrus|V1-20_IGLJ6*01 | 1109 |
| 3767 VH3-23_IGHD6-13*01 > 2_IGHJ3*01 | 1416 | gnl|Fabrus|V1-20_IGLJ6*01 | 1109 |
| 3768 VH3-23_IGHD6-19*01 > 1_IGHJ3*01 | 1417 | gnl|Fabrus|V1-20_IGLJ6*01 | 1109 |
| 3769 VH3-23_IGHD6-19*01 > 2_IGHJ3*01 | 1418 | gnl|Fabrus|V1-20_IGLJ6*01 | 1109 |
| 3770 VH3-23_IGHD6-25*01 > 1_IGHJ3*01 | 1419 | gnl|Fabrus|V1-20_IGLJ6*01 | 1109 |
| 3771 VH3-23_IGHD6-25*01 > 2_IGHJ3*01 | 1420 | gnl|Fabrus|V1-20_IGLJ6*01 | 1109 |
| 3772 VH3-23_IGHD7-27*01 > 1_IGHJ3*01 | 1421 | gnl|Fabrus|V1-20_IGLJ6*01 | 1109 |
| 3773 VH3-23_IGHD7-27*01 > 3_IGHJ3*01 | 1422 | gnl|Fabrus|V1-20_IGLJ6*01 | 1109 |
| 3774 VH3-23_IGHD6-13*01 > 1'_IGHJ3*01 | 1471 | gnl|Fabrus|V1-20_IGLJ6*01 | 1109 |
| 3775 VH3-23_IGHD6-13*01 > 2'_IGHJ3*01 | 1472 | gnl|Fabrus|V1-20_IGLJ6*01 | 1109 |
| 3776 VH3-23_IGHD6-13*01 > 1_IGHJ6*01 | 1818 | gnl|Fabrus|V1-20_IGLJ6*01 | 1109 |
| 3777 VH3-23_IGHD6-19*01 > 1'_IGHJ3*01 | 1474 | gnl|Fabrus|V1-20_IGLJ6*01 | 1109 |
| 3778 VH3-23_IGHD6-19*01 > 2'_IGHJ3*01 | 1475 | gnl|Fabrus|V1-20_IGLJ6*01 | 1109 |
| 3779 VH3-23_IGHD6-19*01 > 3'_IGHJ3*01 | 1476 | gnl|Fabrus|V1-20_IGLJ6*01 | 1109 |
| 3780 VH3-23_IGHD6-25*01 > 1'_IGHJ3*01 | 1477 | gnl|Fabrus|V1-20_IGLJ6*01 | 1109 |
| 3781 VH3-23_IGHD6-25*01 > 3'_IGHJ3*01 | 1478 | gnl|Fabrus|V1-20_IGLJ6*01 | 1109 |
| 3782 VH3-23_IGHD7-27*01 > 1'_IGHJ3*01 | 1479 | gnl|Fabrus|V1-20_IGLJ6*01 | 1109 |
| 3783 VH3-23_IGHD7-27*01 > 2'_IGHJ3*01 | 1480 | gnl|Fabrus|V1-20_IGLJ6*01 | 1109 |
| 3784 VH3-23_IGHD6-6*01 > 2_IGHJ4*01 | 1529 | gnl|Fabrus|V1-20_IGLJ6*01 | 1109 |
| 3785 VH3-23_IGHD6-13*01 > 1_IGHJ4*01 | 1530 | gnl|Fabrus|V1-20_IGLJ6*01 | 1109 |
| 3786 VH3-23_IGHD6-13*01 > 2_IGHJ4*01 | 1531 | gnl|Fabrus|V1-20_IGLJ6*01 | 1109 |
| 3787 VH3-23_IGHD6-19*01 > 1_IGHJ4*01 | 1532 | gnl|Fabrus|V1-20_IGLJ6*01 | 1109 |
| 3788 VH3-23_IGHD6-19*01 > 2_IGHJ4*01 | 1533 | gnl|Fabrus|V1-20_IGLJ6*01 | 1109 |
| 3789 VH3-23_IGHD6-25*01 > 1_IGHJ4*01 | 1534 | gnl|Fabrus|V1-20_IGLJ6*01 | 1109 |
| 3790 VH3-23_IGHD6-25*01 > 2_IGHJ4*01 | 1535 | gnl|Fabrus|V1-20_IGLJ6*01 | 1109 |
| 3791 VH3-23_IGHD7-27*01 > 1_IGHJ4*01 | 1536 | gnl|Fabrus|V1-20_IGLJ6*01 | 1109 |

TABLE 4-continued

Exemplary Paired Nucleic Acid Library

| | HEAVY CHAIN | SEQ ID NO | LIGHT CHAIN | SEQ ID NO |
|---|---|---|---|---|
| 3792 | VH3-23_IGHD7-27*01 > 3_IGHJ4*01 | 1537 | gnl|Fabrus|V1-20_IGLJ6*01 | 1109 |
| 3793 | VH3-23_IGHD6-13*01 > 1'_IGHJ4*01 | 1586 | gnl|Fabrus|V1-20_IGLJ6*01 | 1109 |
| 3794 | VH3-23_IGHD6-13*01 > 2'_IGHJ4*01 | 1587 | gnl|Fabrus|V1-20_IGLJ6*01 | 1109 |
| 3795 | VH3-23_IGHD6-13*01 > 2_IGHJ4*01_B | 1588 | gnl|Fabrus|V1-20_IGLJ6*01 | 1109 |
| 3796 | VH3-23_IGHD6-19*01 > 1'_IGHJ4*01 | 1589 | gnl|Fabrus|V1-20_IGLJ6*01 | 1109 |
| 3797 | VH3-23_IGHD6-19*01 > 2'_IGHJ4*01 | 1590 | gnl|Fabrus|V1-20_IGLJ6*01 | 1109 |
| 3798 | VH3-23_IGHD6-19*01 > 2_IGHJ4*01_B | 1591 | gnl|Fabrus|V1-20_IGLJ6*01 | 1109 |
| 3799 | VH3-23_IGHD6-25*01 > 1'_IGHJ4*01 | 1592 | gnl|Fabrus|V1-20_IGLJ6*01 | 1109 |
| 3800 | VH3-23_IGHD6-25*01 > 3'_IGHJ4*01 | 1593 | gnl|Fabrus|V1-20_IGLJ6*01 | 1109 |
| 3801 | VH3-23_IGHD7-27*01 > 1'_IGHJ4*01 | 1594 | gnl|Fabrus|V1-20_IGLJ6*01 | 1109 |
| 3802 | VH3-23_IGHD7-27*01 > 2'_IGHJ4*01 | 1595 | gnl|Fabrus|V1-20_IGLJ6*01 | 1109 |
| 3803 | VH3-23_IGHD6-6*01 > 2_IGHJ5*01 | 1644 | gnl|Fabrus|V1-20_IGLJ6*01 | 1109 |
| 3804 | VH3-23_IGHD6-13*01 > 1_IGHJ5*01 | 1645 | gnl|Fabrus|V1-20_IGLJ6*01 | 1109 |
| 3805 | VH3-23_IGHD6-13*01 > 2_IGHJ5*01 | 1646 | gnl|Fabrus|V1-20_IGLJ6*01 | 1109 |
| 3806 | VH3-23_IGHD6-19*01 > 1_IGHJ5*01 | 1647 | gnl|Fabrus|V1-20_IGLJ6*01 | 1109 |
| 3807 | VH3-23_IGHD6-19*01 > 2_IGHJ5*01 | 1648 | gnl|Fabrus|V1-20_IGLJ6*01 | 1109 |
| 3808 | VH3-23_IGHD6-25*01 > 1_IGHJ5*01 | 1649 | gnl|Fabrus|V1-20_IGLJ6*01 | 1109 |
| 3809 | VH3-23_IGHD6-25*01 > 2_IGHJ5*01 | 1650 | gnl|Fabrus|V1-20_IGLJ6*01 | 1109 |
| 3810 | VH3-23_IGHD7-27*01 > 1_IGHJ5*01 | 1651 | gnl|Fabrus|V1-20_IGLJ6*01 | 1109 |
| 3811 | VH3-23_IGHD7-27*01 > 3_IGHJ5*01 | 1652 | gnl|Fabrus|V1-20_IGLJ6*01 | 1109 |
| 3812 | VH3-23_IGHD6-13*01 > 1'_IGHJ5*01 | 1701 | gnl|Fabrus|V1-20_IGLJ6*01 | 1109 |
| 3813 | VH3-23_IGHD6-13*01 > 2'_IGHJ5*01 | 1702 | gnl|Fabrus|V1-20_IGLJ6*01 | 1109 |
| 3814 | VH3-23_IGHD6-13*01 > 3'_IGHJ5*01 | 1703 | gnl|Fabrus|V1-20_IGLJ6*01 | 1109 |
| 3815 | VH3-23_IGHD6-19*01 > 1'_IGHJ5*01 | 1704 | gnl|Fabrus|V1-20_IGLJ6*01 | 1109 |
| 3816 | VH3-23_IGHD6-19*01 > 2'_IGHJ5*01 | 1705 | gnl|Fabrus|V1-20_IGLJ6*01 | 1109 |
| 3817 | VH3-23_IGHD6-19*01 > 2_IGHJ5*01_B | 1706 | gnl|Fabrus|V1-20_IGLJ6*01 | 1109 |
| 3818 | VH3-23_IGHD6-25*01 > 1'_IGHJ5*01 | 1707 | gnl|Fabrus|V1-20_IGLJ6*01 | 1109 |
| 3819 | VH3-23_IGHD6-25*01 > 3'_IGHJ5*01 | 1708 | gnl|Fabrus|V1-20_IGLJ6*01 | 1109 |
| 3820 | VH3-23_IGHD7-27*01 > 1'_IGHJ5*01 | 1709 | gnl|Fabrus|V1-20_IGLJ6*01 | 1109 |
| 3821 | VH3-23_IGHD7-27*01 > 2'_IGHJ5*01 | 1710 | gnl|Fabrus|V1-20_IGLJ6*01 | 1109 |
| 3822 | VH3-23_IGHD6-6*01 > 2_IGHJ6*01 | 1759 | gnl|Fabrus|V1-20_IGLJ6*01 | 1109 |
| 3823 | VH3-23_IGHD6-6*01 > 2_IGHJ1*01 | 1184 | gnl|Fabrus|V1-3_IGLJ1*01 | 1110 |
| 3824 | VH3-23_IGHD6-13*01 > 1_IGHJ1*01 | 1185 | gnl|Fabrus|V1-3_IGLJ1*01 | 1110 |
| 3825 | VH3-23_IGHD6-13*01 > 2_IGHJ1*01 | 1186 | gnl|Fabrus|V1-3_IGLJ1*01 | 1110 |
| 3826 | VH3-23_IGHD6-19*01 > 1_IGHJ1*01 | 1187 | gnl|Fabrus|V1-3_IGLJ1*01 | 1110 |
| 3827 | VH3-23_IGHD6-19*01 > 2_IGHJ1*01 | 1188 | gnl|Fabrus|V1-3_IGLJ1*01 | 1110 |
| 3828 | VH3-23_IGHD6-25*01 > 1_IGHJ1*01 | 1189 | gnl|Fabrus|V1-3_IGLJ1*01 | 1110 |
| 3829 | VH3-23_IGHD6-25*01 > 2_IGHJ1*01 | 1190 | gnl|Fabrus|V1-3_IGLJ1*01 | 1110 |
| 3830 | VH3-23_IGHD7-27*01 > 1_IGHJ1*01 | 1191 | gnl|Fabrus|V1-3_IGLJ1*01 | 1110 |
| 3831 | VH3-23_IGHD7-27*01 > 3_IGHJ1*01 | 1192 | gnl|Fabrus|V1-3_IGLJ1*01 | 1110 |
| 3832 | VH3-23_IGHD6-13*01 > 1'_IGHJ1*01 | 1241 | gnl|Fabrus|V1-3_IGLJ1*01 | 1110 |
| 3833 | VH3-23_IGHD6-13*01 > 2'_IGHJ1*01 | 1242 | gnl|Fabrus|V1-3_IGLJ1*01 | 1110 |
| 3834 | VH3-23_IGHD6-13*01 > 2_IGHJ1*01_B | 1243 | gnl|Fabrus|V1-3_IGLJ1*01 | 1110 |
| 3835 | VH3-23_IGHD6-19*01 > 1'_IGHJ1*01 | 1244 | gnl|Fabrus|V1-3_IGLJ1*01 | 1110 |
| 3836 | VH3-23_IGHD6-19*01 > 2'_IGHJ1*01 | 1245 | gnl|Fabrus|V1-3_IGLJ1*01 | 1110 |
| 3837 | VH3-23_IGHD6-19*01 > 2_IGHJ1*01_B | 1246 | gnl|Fabrus|V1-3_IGLJ1*01 | 1110 |
| 3838 | VH3-23_IGHD6-25*01 > 1'_IGHJ1*01 | 1247 | gnl|Fabrus|V1-3_IGLJ1*01 | 1110 |
| 3839 | VH3-23_IGHD6-25*01 > 3'_IGHJ1*01 | 1248 | gnl|Fabrus|V1-3_IGLJ1*01 | 1110 |
| 3840 | VH3-23_IGHD7-27*01 > 1'_IGHJ1*01_B | 1249 | gnl|Fabrus|V1-3_IGLJ1*01 | 1110 |
| 3841 | VH3-23_IGHD7-27*01 > 2'_IGHJ1*01 | 1250 | gnl|Fabrus|V1-3_IGLJ1*01 | 1110 |
| 3842 | VH3-23_IGHD6-6*01 > 2_IGHJ2*01 | 1299 | gnl|Fabrus|V1-3_IGLJ1*01 | 1110 |
| 3843 | VH3-23_IGHD6-13*01 > 1_IGHJ2*01 | 1300 | gnl|Fabrus|V1-3_IGLJ1*01 | 1110 |
| 3844 | VH3-23_IGHD6-13*01 > 2_IGHJ2*01 | 1301 | gnl|Fabrus|V1-3_IGLJ1*01 | 1110 |
| 3845 | VH3-23_IGHD6-19*01 > 1_IGHJ2*01 | 1302 | gnl|Fabrus|V1-3_IGLJ1*01 | 1110 |
| 3846 | VH3-23_IGHD6-19*01 > 2_IGHJ2*01 | 1303 | gnl|Fabrus|V1-3_IGLJ1*01 | 1110 |
| 3847 | VH3-23_IGHD6-25*01 > 1_IGHJ2*01 | 1304 | gnl|Fabrus|V1-3_IGLJ1*01 | 1110 |
| 3848 | VH3-23_IGHD6-25*01 > 2_IGHJ2*01 | 1305 | gnl|Fabrus|V1-3_IGLJ1*01 | 1110 |
| 3849 | VH3-23_IGHD7-27*01 > 1_IGHJ2*01 | 1306 | gnl|Fabrus|V1-3_IGLJ1*01 | 1110 |
| 3850 | VH3-23_IGHD7-27*01 > 3_IGHJ2*01 | 1307 | gnl|Fabrus|V1-3_IGLJ1*01 | 1110 |
| 3851 | VH3-23_IGHD6-13*01 > 1'_IGHJ2*01 | 1356 | gnl|Fabrus|V1-3_IGLJ1*01 | 1110 |
| 3852 | VH3-23_IGHD6-13*01 > 2'_IGHJ2*01 | 1357 | gnl|Fabrus|V1-3_IGLJ1*01 | 1110 |
| 3853 | VH3-23_IGHD6-13*01 > 2_IGHJ2*01_B | 1358 | gnl|Fabrus|V1-3_IGLJ1*01 | 1110 |
| 3854 | VH3-23_IGHD6-19*01 > 1'_IGHJ2*01 | 1359 | gnl|Fabrus|V1-3_IGLJ1*01 | 1110 |
| 3855 | VH3-23_IGHD6-19*01 > 2'_IGHJ2*01 | 1360 | gnl|Fabrus|V1-3_IGLJ1*01 | 1110 |
| 3856 | VH3-23_IGHD6-19*01 > 2_IGHJ2*01_B | 1361 | gnl|Fabrus|V1-3_IGLJ1*01 | 1110 |
| 3857 | VH3-23_IGHD6-25*01 > 1'_IGHJ2*01 | 1362 | gnl|Fabrus|V1-3_IGLJ1*01 | 1110 |
| 3858 | VH3-23_IGHD6-25*01 > 3'_IGHJ2*01 | 1363 | gnl|Fabrus|V1-3_IGLJ1*01 | 1110 |
| 3859 | VH3-23_IGHD7-27*01 > 1'_IGHJ2*01 | 1364 | gnl|Fabrus|V1-3_IGLJ1*01 | 1110 |
| 3860 | VH3-23_IGHD7-27*01 > 2'_IGHJ2*01 | 1365 | gnl|Fabrus|V1-3_IGLJ1*01 | 1110 |
| 3861 | VH3-23_IGHD6-6*01 > 2_IGHJ3*01 | 1414 | gnl|Fabrus|V1-3_IGLJ1*01 | 1110 |
| 3862 | VH3-23_IGHD6-13*01 > 1_IGHJ3*01 | 1415 | gnl|Fabrus|V1-3_IGLJ1*01 | 1110 |
| 3863 | VH3-23_IGHD6-13*01 > 2_IGHJ3*01 | 1416 | gnl|Fabrus|V1-3_IGLJ1*01 | 1110 |
| 3864 | VH3-23_IGHD6-19*01 > 1_IGHJ3*01 | 1417 | gnl|Fabrus|V1-3_IGLJ1*01 | 1110 |
| 3865 | VH3-23_IGHD6-19*01 > 2_IGHJ3*01 | 1418 | gnl|Fabrus|V1-3_IGLJ1*01 | 1110 |

TABLE 4-continued

Exemplary Paired Nucleic Acid Library

| HEAVY CHAIN | SEQ ID NO | LIGHT CHAIN | SEQ ID NO |
|---|---|---|---|
| 3866 VH3-23_IGHD6-25*01 > 1_IGHJ3*01 | 1419 | gnl|Fabrus|V1-3_IGLJ1*01 | 1110 |
| 3867 VH3-23_IGHD6-25*01 > 2_IGHJ3*01 | 1420 | gnl|Fabrus|V1-3_IGLJ1*01 | 1110 |
| 3868 VH3-23_IGHD7-27*01 > 1_IGHJ3*01 | 1421 | gnl|Fabrus|V1-3_IGLJ1*01 | 1110 |
| 3869 VH3-23_IGHD7-27*01 > 3_IGHJ3*01 | 1422 | gnl|Fabrus|V1-3_IGLJ1*01 | 1110 |
| 3870 VH3-23_IGHD6-13*01 > 1'_IGHJ3*01 | 1471 | gnl|Fabrus|V1-3_IGLJ1*01 | 1110 |
| 3871 VH3-23_IGHD6-13*01 > 2'_IGHJ3*01 | 1472 | gnl|Fabrus|V1-3_IGLJ1*01 | 1110 |
| 3872 VH3-23_IGHD6-13*01 > 1_IGHJ6*01 | 1818 | gnl|Fabrus|V1-3_IGLJ1*01 | 1110 |
| 3873 VH3-23_IGHD6-19*01 > 1'_IGHJ3*01 | 1474 | gnl|Fabrus|V1-3_IGLJ1*01 | 1110 |
| 3874 VH3-23_IGHD6-19*01 > 2'_IGHJ3*01 | 1475 | gnl|Fabrus|V1-3_IGLJ1*01 | 1110 |
| 3875 VH3-23_IGHD6-19*01 > 3'_IGHJ3*01 | 1476 | gnl|Fabrus|V1-3_IGLJ1*01 | 1110 |
| 3876 VH3-23_IGHD6-25*01 > 1'_IGHJ3*01 | 1477 | gnl|Fabrus|V1-3_IGLJ1*01 | 1110 |
| 3877 VH3-23_IGHD6-25*01 > 3'_IGHJ3*01 | 1478 | gnl|Fabrus|V1-3_IGLJ1*01 | 1110 |
| 3878 VH3-23_IGHD7-27*01 > 1'_IGHJ3*01 | 1479 | gnl|Fabrus|V1-3_IGLJ1*01 | 1110 |
| 3879 VH3-23_IGHD7-27*01 > 2'_IGHJ3*01 | 1480 | gnl|Fabrus|V1-3_IGLJ1*01 | 1110 |
| 3880 VH3-23_IGHD6-6*01 > 2_IGHJ4*01 | 1529 | gnl|Fabrus|V1-3_IGLJ1*01 | 1110 |
| 3881 VH3-23_IGHD6-13*01 > 1_IGHJ4*01 | 1530 | gnl|Fabrus|V1-3_IGLJ1*01 | 1110 |
| 3882 VH3-23_IGHD6-13*01 > 2_IGHJ4*01 | 1531 | gnl|Fabrus|V1-3_IGLJ1*01 | 1110 |
| 3883 VH3-23_IGHD6-19*01 > 1_IGHJ4*01 | 1532 | gnl|Fabrus|V1-3_IGLJ1*01 | 1110 |
| 3884 VH3-23_IGHD6-19*01 > 2_IGHJ4*01 | 1533 | gnl|Fabrus|V1-3_IGLJ1*01 | 1110 |
| 3885 VH3-23_IGHD6-25*01 > 1_IGHJ4*01 | 1534 | gnl|Fabrus|V1-3_IGLJ1*01 | 1110 |
| 3886 VH3-23_IGHD6-25*01 > 2_IGHJ4*01 | 1535 | gnl|Fabrus|V1-3_IGLJ1*01 | 1110 |
| 3887 VH3-23_IGHD7-27*01 > 1_IGHJ4*01 | 1536 | gnl|Fabrus|V1-3_IGLJ1*01 | 1110 |
| 3888 VH3-23_IGHD7-27*01 > 3_IGHJ4*01 | 1537 | gnl|Fabrus|V1-3_IGLJ1*01 | 1110 |
| 3889 VH3-23_IGHD6-13*01 > 1'_IGHJ4*01 | 1586 | gnl|Fabrus|V1-3_IGLJ1*01 | 1110 |
| 3890 VH3-23_IGHD6-13*01 > 2'_IGHJ4*01 | 1587 | gnl|Fabrus|V1-3_IGLJ1*01 | 1110 |
| 3891 VH3-23_IGHD6-13*01 > 2_IGHJ4*01_B | 1588 | gnl|Fabrus|V1-3_IGLJ1*01 | 1110 |
| 3892 VH3-23_IGHD6-19*01 > 1'_IGHJ4*01 | 1589 | gnl|Fabrus|V1-3_IGLJ1*01 | 1110 |
| 3893 VH3-23_IGHD6-19*01 > 2'_IGHJ4*01 | 1590 | gnl|Fabrus|V1-3_IGLJ1*01 | 1110 |
| 3894 VH3-23_IGHD6-19*01 > 2_IGHJ4*01_B | 1591 | gnl|Fabrus|V1-3_IGLJ1*01 | 1110 |
| 3895 VH3-23_IGHD6-25*01 > 1'_IGHJ4*01 | 1592 | gnl|Fabrus|V1-3_IGLJ1*01 | 1110 |
| 3896 VH3-23_IGHD6-25*01 > 3'_IGHJ4*01 | 1593 | gnl|Fabrus|V1-3_IGLJ1*01 | 1110 |
| 3897 VH3-23_IGHD7-27*01 > 1'_IGHJ4*01 | 1594 | gnl|Fabrus|V1-3_IGLJ1*01 | 1110 |
| 3898 VH3-23_IGHD7-27*01 > 2'_IGHJ4*01 | 1595 | gnl|Fabrus|V1-3_IGLJ1*01 | 1110 |
| 3899 VH3-23_IGHD6-6*01 > 2_IGHJ5*01 | 1644 | gnl|Fabrus|V1-3_IGLJ1*01 | 1110 |
| 3900 VH3-23_IGHD6-13*01 > 1_IGHJ5*01 | 1645 | gnl|Fabrus|V1-3_IGLJ1*01 | 1110 |
| 3901 VH3-23_IGHD6-13*01 > 2_IGHJ5*01 | 1646 | gnl|Fabrus|V1-3_IGLJ1*01 | 1110 |
| 3902 VH3-23_IGHD6-19*01 > 1_IGHJ5*01 | 1647 | gnl|Fabrus|V1-3_IGLJ1*01 | 1110 |
| 3903 VH3-23_IGHD6-19*01 > 2_IGHJ5*01 | 1648 | gnl|Fabrus|V1-3_IGLJ1*01 | 1110 |
| 3904 VH3-23_IGHD6-25*01 > 1_IGHJ5*01 | 1649 | gnl|Fabrus|V1-3_IGLJ1*01 | 1110 |
| 3905 VH3-23_IGHD6-25*01 > 2_IGHJ5*01 | 1650 | gnl|Fabrus|V1-3_IGLJ1*01 | 1110 |
| 3906 VH3-23_IGHD7-27*01 > 1_IGHJ5*01 | 1651 | gnl|Fabrus|V1-3_IGLJ1*01 | 1110 |
| 3907 VH3-23_IGHD7-27*01 > 3_IGHJ5*01 | 1652 | gnl|Fabrus|V1-3_IGLJ1*01 | 1110 |
| 3908 VH3-23_IGHD6-13*01 > 1'_IGHJ5*01 | 1701 | gnl|Fabrus|V1-3_IGLJ1*01 | 1110 |
| 3909 VH3-23_IGHD6-13*01 > 2'_IGHJ5*01 | 1702 | gnl|Fabrus|V1-3_IGLJ1*01 | 1110 |
| 3910 VH3-23_IGHD6-13*01 > 3'_IGHJ5*01 | 1703 | gnl|Fabrus|V1-3_IGLJ1*01 | 1110 |
| 3911 VH3-23_IGHD6-19*01 > 1'_IGHJ5*01 | 1704 | gnl|Fabrus|V1-3_IGLJ1*01 | 1110 |
| 3912 VH3-23_IGHD6-19*01 > 2'_IGHJ5*01 | 1705 | gnl|Fabrus|V1-3_IGLJ1*01 | 1110 |
| 3913 VH3-23_IGHD6-19*01 > 2_IGHJ5*01_B | 1706 | gnl|Fabrus|V1-3_IGLJ1*01 | 1110 |
| 3914 VH3-23_IGHD6-25*01 > 1'_IGHJ5*01 | 1707 | gnl|Fabrus|V1-3_IGLJ1*01 | 1110 |
| 3915 VH3-23_IGHD6-25*01 > 3'_IGHJ5*01 | 1708 | gnl|Fabrus|V1-3_IGLJ1*01 | 1110 |
| 3916 VH3-23_IGHD7-27*01 > 1'_IGHJ5*01 | 1709 | gnl|Fabrus|V1-3_IGLJ1*01 | 1110 |
| 3917 VH3-23_IGHD7-27*01 > 2'_IGHJ5*01 | 1710 | gnl|Fabrus|V1-3_IGLJ1*01 | 1110 |
| 3918 VH3-23_IGHD6-6*01 > 2_IGHJ6*01 | 1759 | gnl|Fabrus|V1-3_IGLJ1*01 | 1110 |
| 3919 VH3-23_IGHD1-1*01 > 1_IGHJ6*01 | 1711 | gnl|Fabrus|V2-13_IGLJ2*01 | 1117 |
| 3920 VH3-23_IGHD1-1*01 > 2_IGHJ6*01 | 1712 | gnl|Fabrus|V2-13_IGLJ2*01 | 1117 |
| 3921 VH3-23_IGHD1-1*01 > 3_IGHJ6*01 | 1713 | gnl|Fabrus|V2-13_IGLJ2*01 | 1117 |
| 3922 VH3-23_IGHD1-7*01 > 1_IGHJ6*01 | 1714 | gnl|Fabrus|V2-13_IGLJ2*01 | 1117 |
| 3923 VH3-23_IGHD1-7*01 > 3_IGHJ6*01 | 1715 | gnl|Fabrus|V2-13_IGLJ2*01 | 1117 |
| 3924 VH3-23_IGHD1-14*01 > 1_IGHJ6*01 | 1716 | gnl|Fabrus|V2-13_IGLJ2*01 | 1117 |
| 3925 VH3-23_IGHD1-14*01 > 3_IGHJ6*01 | 1717 | gnl|Fabrus|V2-13_IGLJ2*01 | 1117 |
| 3926 VH3-23_IGHD1-20*01 > 1_IGHJ6*01 | 1718 | gnl|Fabrus|V2-13_IGLJ2*01 | 1117 |
| 3927 VH3-23_IGHD1-20*01 > 3_IGHJ6*01 | 1719 | gnl|Fabrus|V2-13_IGLJ2*01 | 1117 |
| 3928 VH3-23_IGHD1-26*01 > 1_IGHJ6*01 | 1720 | gnl|Fabrus|V2-13_IGLJ2*01 | 1117 |
| 3929 VH3-23_IGHD1-26*01 > 3_IGHJ6*01 | 1721 | gnl|Fabrus|V2-13_IGLJ2*01 | 1117 |
| 3930 VH3-23_IGHD2-2*01 > 2_IGHJ6*01 | 1722 | gnl|Fabrus|V2-13_IGLJ2*01 | 1117 |
| 3931 VH3-23_IGHD2-2*01 > 3_IGHJ6*01 | 1723 | gnl|Fabrus|V2-13_IGLJ2*01 | 1117 |
| 3932 VH3-23_IGHD2-8*01 > 2_IGHJ6*01 | 1724 | gnl|Fabrus|V2-13_IGLJ2*01 | 1117 |
| 3933 VH3-23_IGHD2-8*01 > 3_IGHJ6*01 | 1725 | gnl|Fabrus|V2-13_IGLJ2*01 | 1117 |
| 3934 VH3-23_IGHD2-15*01 > 2_IGHJ6*01 | 1726 | gnl|Fabrus|V2-13_IGLJ2*01 | 1117 |
| 3935 VH3-23_IGHD2-15*01 > 3_IGHJ6*01 | 1727 | gnl|Fabrus|V2-13_IGLJ2*01 | 1117 |
| 3936 VH3-23_IGHD2-21*01 > 2_IGHJ6*01 | 1728 | gnl|Fabrus|V2-13_IGLJ2*01 | 1117 |
| 3937 VH3-23_IGHD2-21*01 > 3_IGHJ6*01 | 1729 | gnl|Fabrus|V2-13_IGLJ2*01 | 1117 |
| 3938 VH3-23_IGHD3-3*01 > 1_IGHJ6*01 | 1730 | gnl|Fabrus|V2-13_IGLJ2*01 | 1117 |
| 3939 VH3-23_IGHD3-3*01 > 2_IGHJ6*01 | 1731 | gnl|Fabrus|V2-13_IGLJ2*01 | 1117 |

TABLE 4-continued

Exemplary Paired Nucleic Acid Library

| | HEAVY CHAIN | SEQ ID NO | LIGHT CHAIN | SEQ ID NO |
|---|---|---|---|---|
| 3940 | VH3-23_IGHD3-3*01 > 3_IGHJ6*01 | 1732 | gnl|Fabrus|V2-13_IGLJ2*01 | 1117 |
| 3941 | VH3-23_IGHD3-9*01 > 2_IGHJ6*01 | 1733 | gnl|Fabrus|V2-13_IGLJ2*01 | 1117 |
| 3942 | VH3-23_IGHD3-10*01 > 2_IGHJ6*01 | 1734 | gnl|Fabrus|V2-13_IGLJ2*01 | 1117 |
| 3943 | VH3-23_IGHD3-10*01 > 3_IGHJ6*01 | 1735 | gnl|Fabrus|V2-13_IGLJ2*01 | 1117 |
| 3944 | VH3-23_IGHD3-16*01 > 2_IGHJ6*01 | 1736 | gnl|Fabrus|V2-13_IGLJ2*01 | 1117 |
| 3945 | VH3-23_IGHD3-16*01 > 3_IGHJ6*01 | 1737 | gnl|Fabrus|V2-13_IGLJ2*01 | 1117 |
| 3946 | VH3-23_IGHD3-22*01 > 2_IGHJ6*01 | 1738 | gnl|Fabrus|V2-13_IGLJ2*01 | 1117 |
| 3947 | VH3-23_IGHD3-22*01 > 3_IGHJ6*01 | 1739 | gnl|Fabrus|V2-13_IGLJ2*01 | 1117 |
| 3948 | VH3-23_IGHD4-4*01 (1) > 2_IGHJ6*01 | 1740 | gnl|Fabrus|V2-13_IGLJ2*01 | 1117 |
| 3949 | VH3-23_IGHD4-4*01 (1) > 3_IGHJ6*01 | 1741 | gnl|Fabrus|V2-13_IGLJ2*01 | 1117 |
| 3950 | VH3-23_IGHD4-11*01 (1) > 2_IGHJ6*01 | 1742 | gnl|Fabrus|V2-13_IGLJ2*01 | 1117 |
| 3951 | VH3-23_IGHD4-11*01 (1) > 3_IGHJ6*01 | 1743 | gnl|Fabrus|V2-13_IGLJ2*01 | 1117 |
| 3952 | VH3-23_IGHD4-17*01 > 2_IGHJ6*01 | 1744 | gnl|Fabrus|V2-13_IGLJ2*01 | 1117 |
| 3953 | VH3-23_IGHD4-17*01 > 3_IGHJ6*01 | 1745 | gnl|Fabrus|V2-13_IGLJ2*01 | 1117 |
| 3954 | VH3-23_IGHD4-23*01 > 2_IGHJ6*01 | 1746 | gnl|Fabrus|V2-13_IGLJ2*01 | 1117 |
| 3955 | VH3-23_IGHD4-23*01 > 3_IGHJ6*01 | 1747 | gnl|Fabrus|V2-13_IGLJ2*01 | 1117 |
| 3956 | VH3-23_IGHD5-5*01 (2) > 1_IGHJ6*01 | 1748 | gnl|Fabrus|V2-13_IGLJ2*01 | 1117 |
| 3957 | VH3-23_IGHD5-5*01 (2) > 2_IGHJ6*01 | 1749 | gnl|Fabrus|V2-13_IGLJ2*01 | 1117 |
| 3958 | VH3-23_IGHD5-5*01 (2) > 3_IGHJ6*01 | 1750 | gnl|Fabrus|V2-13_IGLJ2*01 | 1117 |
| 3959 | VH3-23_IGHD5-12*01 > 1_IGHJ6*01 | 1751 | gnl|Fabrus|V2-13_IGLJ2*01 | 1117 |
| 3960 | VH3-23_IGHD5-12*01 > 3_IGHJ6*01 | 1752 | gnl|Fabrus|V2-13_IGLJ2*01 | 1117 |
| 3961 | VH3-23_IGHD5-18*01 (2) > 1_IGHJ6*01 | 1753 | gnl|Fabrus|V2-13_IGLJ2*01 | 1117 |
| 3962 | VH3-23_IGHD5-18*01 (2) > 2_IGHJ6*01 | 1754 | gnl|Fabrus|V2-13_IGLJ2*01 | 1117 |
| 3963 | VH3-23_IGHD5-18*01 (2) > 3_IGHJ6*01 | 1755 | gnl|Fabrus|V2-13_IGLJ2*01 | 1117 |
| 3964 | VH3-23_IGHD5-24*01 > 1_IGHJ6*01 | 1756 | gnl|Fabrus|V2-13_IGLJ2*01 | 1117 |
| 3965 | VH3-23_IGHD5-24*01 > 3_IGHJ6*01 | 1757 | gnl|Fabrus|V2-13_IGLJ2*01 | 1117 |
| 3966 | VH3-23_IGHD6-6*01 > 1_IGHJ6*01 | 1758 | gnl|Fabrus|V2-13_IGLJ2*01 | 1117 |
| 3967 | VH3-23_IGHD1-1*01 > 1'_IGHJ6*01 | 1768 | gnl|Fabrus|V2-13_IGLJ2*01 | 1117 |
| 3968 | VH3-23_IGHD1-1*01 > 2'_IGHJ6*01 | 1769 | gnl|Fabrus|V2-13_IGLJ2*01 | 1117 |
| 3969 | VH3-23_IGHD1-1*01 > 3'_IGHJ6*01 | 1770 | gnl|Fabrus|V2-13_IGLJ2*01 | 1117 |
| 3970 | VH3-23_IGHD1-7*01 > 1'_IGHJ6*01 | 1771 | gnl|Fabrus|V2-13_IGLJ2*01 | 1117 |
| 3971 | VH3-23_IGHD1-7*01 > 3'_IGHJ6*01 | 1772 | gnl|Fabrus|V2-13_IGLJ2*01 | 1117 |
| 3972 | VH3-23_IGHD1-14*01 > 1'_IGHJ6*01 | 1773 | gnl|Fabrus|V2-13_IGLJ2*01 | 1117 |
| 3973 | VH3-23_IGHD1-14*01 > 2'_IGHJ6*01 | 1774 | gnl|Fabrus|V2-13_IGLJ2*01 | 1117 |
| 3974 | VH3-23_IGHD1-14*01 > 3'_IGHJ6*01 | 1775 | gnl|Fabrus|V2-13_IGLJ2*01 | 1117 |
| 3975 | VH3-23_IGHD1-20*01 > 1'_IGHJ6*01 | 1776 | gnl|Fabrus|V2-13_IGLJ2*01 | 1117 |
| 3976 | VH3-23_IGHD1-20*01 > 2'_IGHJ6*01 | 1777 | gnl|Fabrus|V2-13_IGLJ2*01 | 1117 |
| 3977 | VH3-23_IGHD1-20*01 > 3'_IGHJ6*01 | 1778 | gnl|Fabrus|V2-13_IGLJ2*01 | 1117 |
| 3978 | VH3-23_IGHD1-26*01 > 1'_IGHJ6*01 | 1779 | gnl|Fabrus|V2-13_IGLJ2*01 | 1117 |
| 3979 | VH3-23_IGHD1-26*01 > 1_IGHJ6*01_B | 1780 | gnl|Fabrus|V2-13_IGLJ2*01 | 1117 |
| 3980 | VH3-23_IGHD2-2*01 > 2_IGHJ6*01_B | 1781 | gnl|Fabrus|V2-13_IGLJ2*01 | 1117 |
| 3981 | VH3-23_IGHD2-2*01 > 3'_IGHJ6*01 | 1782 | gnl|Fabrus|V2-13_IGLJ2*01 | 1117 |
| 3982 | VH3-23_IGHD2-8*01 > 1'_IGHJ6*01 | 1783 | gnl|Fabrus|V2-13_IGLJ2*01 | 1117 |
| 3983 | VH3-23_IGHD2-15*01 > 1'_IGHJ6*01 | 1784 | gnl|Fabrus|V2-13_IGLJ2*01 | 1117 |
| 3984 | VH3-23_IGHD2-15*01 > 3'_IGHJ6*01 | 1785 | gnl|Fabrus|V2-13_IGLJ2*01 | 1117 |
| 3985 | VH3-23_IGHD2-21*01 > 1'_IGHJ6*01 | 1786 | gnl|Fabrus|V2-13_IGLJ2*01 | 1117 |
| 3986 | VH3-23_IGHD2-21*01 > 3'_IGHJ6*01 | 1787 | gnl|Fabrus|V2-13_IGLJ2*01 | 1117 |
| 3987 | VH3-23_IGHD3-3*01 > 1'_IGHJ6*01 | 1788 | gnl|Fabrus|V2-13_IGLJ2*01 | 1117 |
| 3988 | VH3-23_IGHD3-3*01 > 3'_IGHJ6*01 | 1789 | gnl|Fabrus|V2-13_IGLJ2*01 | 1117 |
| 3989 | VH3-23_IGHD3-9*01 > 1'_IGHJ6*01 | 1790 | gnl|Fabrus|V2-13_IGLJ2*01 | 1117 |
| 3990 | VH3-23_IGHD3-9*01 > 3'_IGHJ6*01 | 1791 | gnl|Fabrus|V2-13_IGLJ2*01 | 1117 |
| 3991 | VH3-23_IGHD3-10*01 > 1'_IGHJ6*01 | 1792 | gnl|Fabrus|V2-13_IGLJ2*01 | 1117 |
| 3992 | VH3-23_IGHD3-10*01 > 3'_IGHJ6*01 | 1793 | gnl|Fabrus|V2-13_IGLJ2*01 | 1117 |
| 3993 | VH3-23_IGHD3-16*01 > 1'_IGHJ6*01 | 1794 | gnl|Fabrus|V2-13_IGLJ2*01 | 1117 |
| 3994 | VH3-23_IGHD3-16*01 > 3'_IGHJ6*01 | 1795 | gnl|Fabrus|V2-13_IGLJ2*01 | 1117 |
| 3995 | VH3-23_IGHD3-22*01 > 1'_IGHJ6*01 | 1796 | gnl|Fabrus|V2-13_IGLJ2*01 | 1117 |
| 3996 | VH3-23_IGHD4-4*01 (1) > 1'_IGHJ6*01 | 1797 | gnl|Fabrus|V2-13_IGLJ2*01 | 1117 |
| 3997 | VH3-23_IGHD4-4*01 (1) > 3'_IGHJ6*01 | 1798 | gnl|Fabrus|V2-13_IGLJ2*01 | 1117 |
| 3998 | VH3-23_IGHD4-11*01 (1) > 1'_IGHJ6*01 | 1799 | gnl|Fabrus|V2-13_IGLJ2*01 | 1117 |
| 3999 | VH3-23_IGHD4-11*01 (1) > 3'_IGHJ6*01 | 1800 | gnl|Fabrus|V2-13_IGLJ2*01 | 1117 |
| 4000 | VH3-23_IGHD4-17*01 > 1'_IGHJ6*01 | 1801 | gnl|Fabrus|V2-13_IGLJ2*01 | 1117 |
| 4001 | VH3-23_IGHD4-17*01 > 3'_IGHJ6*01 | 1802 | gnl|Fabrus|V2-13_IGLJ2*01 | 1117 |
| 4002 | VH3-23_IGHD4-23*01 > 1'_IGHJ6*01 | 1803 | gnl|Fabrus|V2-13_IGLJ2*01 | 1117 |
| 4003 | VH3-23_IGHD4-23*01 > 3'_IGHJ6*01 | 1804 | gnl|Fabrus|V2-13_IGLJ2*01 | 1117 |
| 4004 | VH3-23_IGHD5-5*01 (2) > 1'_IGHJ6*01 | 1805 | gnl|Fabrus|V2-13_IGLJ2*01 | 1117 |
| 4005 | VH3-23_IGHD5-5*01 (2) > 3'_IGHJ6*01 | 1806 | gnl|Fabrus|V2-13_IGLJ2*01 | 1117 |
| 4006 | VH3-23_IGHD5-12*01 > 1'_IGHJ6*01 | 1807 | gnl|Fabrus|V2-13_IGLJ2*01 | 1117 |
| 4007 | VH3-23_IGHD5-12*01 > 3'_IGHJ6*01 | 1808 | gnl|Fabrus|V2-13_IGLJ2*01 | 1117 |
| 4008 | VH3-23_IGHD5-18*01 (2) > 1'_IGHJ6*01 | 1809 | gnl|Fabrus|V2-13_IGLJ2*01 | 1117 |
| 4009 | VH3-23_IGHD5-18*01 (2) > 3'_IGHJ6*01 | 1810 | gnl|Fabrus|V2-13_IGLJ2*01 | 1117 |
| 4010 | VH3-23_IGHD5-24*01 > 1'_IGHJ6*01 | 1811 | gnl|Fabrus|V2-13_IGLJ2*01 | 1117 |
| 4011 | VH3-23_IGHD5-24*01 > 3'_IGHJ6*01 | 1812 | gnl|Fabrus|V2-13_IGLJ2*01 | 1117 |
| 4012 | VH3-23_IGHD6-6*01 > 1'_IGHJ6*01 | 1813 | gnl|Fabrus|V2-13_IGLJ2*01 | 1117 |
| 4013 | VH3-23_IGHD6-6*01 > 2'_IGHJ6*01 | 1814 | gnl|Fabrus|V2-13_IGLJ2*01 | 1117 |

TABLE 4-continued

Exemplary Paired Nucleic Acid Library

| HEAVY CHAIN | SEQ ID NO | LIGHT CHAIN | SEQ ID NO |
|---|---|---|---|
| 4014 VH3-23_IGHD6-6*01 > 3'_IGHJ6*01 | 1815 | gnl\|Fabrus\|V2-13_IGLJ2*01 | 1117 |
| 4015 VH3-23_IGHD1-1*01 > 1_IGHJ6*01 | 1711 | gnl\|Fabrus\|V2-14_IGLJ4*01 | 1118 |
| 4016 VH3-23_IGHD1-1*01 > 2_IGHJ6*01 | 1712 | gnl\|Fabrus\|V2-14_IGLJ4*01 | 1118 |
| 4017 VH3-23_IGHD1-1*01 > 3_IGHJ6*01 | 1713 | gnl\|Fabrus\|V2-14_IGLJ4*01 | 1118 |
| 4018 VH3-23_IGHD1-7*01 > 1_IGHJ6*01 | 1714 | gnl\|Fabrus\|V2-14_IGLJ4*01 | 1118 |
| 4019 VH3-23_IGHD1-7*01 > 3_IGHJ6*01 | 1715 | gnl\|Fabrus\|V2-14_IGLJ4*01 | 1118 |
| 4020 VH3-23_IGHD1-14*01 > 1_IGHJ6*01 | 1716 | gnl\|Fabrus\|V2-14_IGLJ4*01 | 1118 |
| 4021 VH3-23_IGHD1-14*01 > 3_IGHJ6*01 | 1717 | gnl\|Fabrus\|V2-14_IGLJ4*01 | 1118 |
| 4022 VH3-23_IGHD1-20*01 > 1_IGHJ6*01 | 1718 | gnl\|Fabrus\|V2-14_IGLJ4*01 | 1118 |
| 4023 VH3-23_IGHD1-20*01 > 3_IGHJ6*01 | 1719 | gnl\|Fabrus\|V2-14_IGLJ4*01 | 1118 |
| 4024 VH3-23_IGHD1-26*01 > 1_IGHJ6*01 | 1720 | gnl\|Fabrus\|V2-14_IGLJ4*01 | 1118 |
| 4025 VH3-23_IGHD1-26*01 > 3_IGHJ6*01 | 1721 | gnl\|Fabrus\|V2-14_IGLJ4*01 | 1118 |
| 4026 VH3-23_IGHD2-2*01 > 2_IGHJ6*01 | 1722 | gnl\|Fabrus\|V2-14_IGLJ4*01 | 1118 |
| 4027 VH3-23_IGHD2-2*01 > 3_IGHJ6*01 | 1723 | gnl\|Fabrus\|V2-14_IGLJ4*01 | 1118 |
| 4028 VH3-23_IGHD2-8*01 > 2_IGHJ6*01 | 1724 | gnl\|Fabrus\|V2-14_IGLJ4*01 | 1118 |
| 4029 VH3-23_IGHD2-8*01 > 3_IGHJ6*01 | 1725 | gnl\|Fabrus\|V2-14_IGLJ4*01 | 1118 |
| 4030 VH3-23_IGHD2-15*01 > 2_IGHJ6*01 | 1726 | gnl\|Fabrus\|V2-14_IGLJ4*01 | 1118 |
| 4031 VH3-23_IGHD2-15*01 > 3_IGHJ6*01 | 1727 | gnl\|Fabrus\|V2-14_IGLJ4*01 | 1118 |
| 4032 VH3-23_IGHD2-21*01 > 2_IGHJ6*01 | 1728 | gnl\|Fabrus\|V2-14_IGLJ4*01 | 1118 |
| 4033 VH3-23_IGHD2-21*01 > 3_IGHJ6*01 | 1729 | gnl\|Fabrus\|V2-14_IGLJ4*01 | 1118 |
| 4034 VH3-23_IGHD3-3*01 > 1_IGHJ6*01 | 1730 | gnl\|Fabrus\|V2-14_IGLJ4*01 | 1118 |
| 4035 VH3-23_IGHD3-3*01 > 2_IGHJ6*01 | 1731 | gnl\|Fabrus\|V2-14_IGLJ4*01 | 1118 |
| 4036 VH3-23_IGHD3-3*01 > 3_IGHJ6*01 | 1732 | gnl\|Fabrus\|V2-14_IGLJ4*01 | 1118 |
| 4037 VH3-23_IGHD3-9*01 > 2_IGHJ6*01 | 1733 | gnl\|Fabrus\|V2-14_IGLJ4*01 | 1118 |
| 4038 VH3-23_IGHD3-10*01 > 2_IGHJ6*01 | 1734 | gnl\|Fabrus\|V2-14_IGLJ4*01 | 1118 |
| 4039 VH3-23_IGHD3-10*01 > 3_IGHJ6*01 | 1735 | gnl\|Fabrus\|V2-14_IGLJ4*01 | 1118 |
| 4040 VH3-23_IGHD3-16*01 > 2_IGHJ6*01 | 1736 | gnl\|Fabrus\|V2-14_IGLJ4*01 | 1118 |
| 4041 VH3-23_IGHD3-16*01 > 3_IGHJ6*01 | 1737 | gnl\|Fabrus\|V2-14_IGLJ4*01 | 1118 |
| 4042 VH3-23_IGHD3-22*01 > 2_IGHJ6*01 | 1738 | gnl\|Fabrus\|V2-14_IGLJ4*01 | 1118 |
| 4043 VH3-23_IGHD3-22*01 > 3_IGHJ6*01 | 1739 | gnl\|Fabrus\|V2-14_IGLJ4*01 | 1118 |
| 4044 VH3-23_IGHD4-4*01 (1) > 2_IGHJ6*01 | 1740 | gnl\|Fabrus\|V2-14_IGLJ4*01 | 1118 |
| 4045 VH3-23_IGHD4-4*01 (1) > 3_IGHJ6*01 | 1741 | gnl\|Fabrus\|V2-14_IGLJ4*01 | 1118 |
| 4046 VH3-23_IGHD4-11*01 (1) > 2_IGHJ6*01 | 1742 | gnl\|Fabrus\|V2-14_IGLJ4*01 | 1118 |
| 4047 VH3-23_IGHD4-11*01 (1) > 3_IGHJ6*01 | 1743 | gnl\|Fabrus\|V2-14_IGLJ4*01 | 1118 |
| 4048 VH3-23_IGHD4-17*01 > 2_IGHJ6*01 | 1744 | gnl\|Fabrus\|V2-14_IGLJ4*01 | 1118 |
| 4049 VH3-23_IGHD4-17*01 > 3_IGHJ6*01 | 1745 | gnl\|Fabrus\|V2-14_IGLJ4*01 | 1118 |
| 4050 VH3-23_IGHD4-23*01 > 2_IGHJ6*01 | 1746 | gnl\|Fabrus\|V2-14_IGLJ4*01 | 1118 |
| 4051 VH3-23_IGHD4-23*01 > 3_IGHJ6*01 | 1747 | gnl\|Fabrus\|V2-14_IGLJ4*01 | 1118 |
| 4052 VH3-23_IGHD5-5*01 (2) > 1_IGHJ6*01 | 1748 | gnl\|Fabrus\|V2-14_IGLJ4*01 | 1118 |
| 4053 VH3-23_IGHD5-5*01 (2) > 2_IGHJ6*01 | 1749 | gnl\|Fabrus\|V2-14_IGLJ4*01 | 1118 |
| 4054 VH3-23_IGHD5-5*01 (2) > 3_IGHJ6*01 | 1750 | gnl\|Fabrus\|V2-14_IGLJ4*01 | 1118 |
| 4055 VH3-23_IGHD5-12*01 > 1_IGHJ6*01 | 1751 | gnl\|Fabrus\|V2-14_IGLJ4*01 | 1118 |
| 4056 VH3-23_IGHD5-12*01 > 3_IGHJ6*01 | 1752 | gnl\|Fabrus\|V2-14_IGLJ4*01 | 1118 |
| 4057 VH3-23_IGHD5-18*01 (2) > 1_IGHJ6*01 | 1753 | gnl\|Fabrus\|V2-14_IGLJ4*01 | 1118 |
| 4058 VH3-23_IGHD5-18*01 (2) > 2_IGHJ6*01 | 1754 | gnl\|Fabrus\|V2-14_IGLJ4*01 | 1118 |
| 4059 VH3-23_IGHD5-18*01 (2) > 3_IGHJ6*01 | 1755 | gnl\|Fabrus\|V2-14_IGLJ4*01 | 1118 |
| 4060 VH3-23_IGHD5-24*01 > 1_IGHJ6*01 | 1756 | gnl\|Fabrus\|V2-14_IGLJ4*01 | 1118 |
| 4061 VH3-23_IGHD5-24*01 > 3_IGHJ6*01 | 1757 | gnl\|Fabrus\|V2-14_IGLJ4*01 | 1118 |
| 4062 VH3-23_IGHD6-6*01 > 1_IGHJ6*01 | 1758 | gnl\|Fabrus\|V2-14_IGLJ4*01 | 1118 |
| 4063 VH3-23_IGHD1-1*01 > 1'_IGHJ6*01 | 1768 | gnl\|Fabrus\|V2-14_IGLJ4*01 | 1118 |
| 4064 VH3-23_IGHD1-1*01 > 2'_IGHJ6*01 | 1769 | gnl\|Fabrus\|V2-14_IGLJ4*01 | 1118 |
| 4065 VH3-23_IGHD1-1*01 > 3'_IGHJ6*01 | 1770 | gnl\|Fabrus\|V2-14_IGLJ4*01 | 1118 |
| 4066 VH3-23_IGHD1-7*01 > 1'_IGHJ6*01 | 1771 | gnl\|Fabrus\|V2-14_IGLJ4*01 | 1118 |
| 4067 VH3-23_IGHD1-7*01 > 3'_IGHJ6*01 | 1772 | gnl\|Fabrus\|V2-14_IGLJ2*01 | 1118 |
| 4068 VH3-23_IGHD1-14*01 > 1'_IGHJ6*01 | 1773 | gnl\|Fabrus\|V2-14_IGLJ4*01 | 1118 |
| 4069 VH3-23_IGHD1-14*01 > 2'_IGHJ6*01 | 1774 | gnl\|Fabrus\|V2-14_IGLJ4*01 | 1118 |
| 4070 VH3-23_IGHD1-14*01 > 3'_IGHJ6*01 | 1775 | gnl\|Fabrus\|V2-14_IGLJ4*01 | 1118 |
| 4071 VH3-23_IGHD1-20*01 > 1'_IGHJ6*01 | 1776 | gnl\|Fabrus\|V2-14_IGLJ4*01 | 1118 |
| 4072 VH3-23_IGHD1-20*01 > 2'_IGHJ6*01 | 1777 | gnl\|Fabrus\|V2-14_IGLJ4*01 | 1118 |
| 4073 VH3-23_IGHD1-20*01 > 3'_IGHJ6*01 | 1778 | gnl\|Fabrus\|V2-14_IGLJ4*01 | 1118 |
| 4074 VH3-23_IGHD1-26*01 > 1'_IGHJ6*01 | 1779 | gnl\|Fabrus\|V2-14_IGLJ4*01 | 1118 |
| 4075 VH3-23_IGHD1-26*01 > 1_IGHJ6*01_B | 1780 | gnl\|Fabrus\|V2-14_IGLJ4*01 | 1118 |
| 4076 VH3-23_IGHD2-2*01 > 2_IGHJ6*01_B | 1781 | gnl\|Fabrus\|V2-14_IGLJ4*01 | 1118 |
| 4077 VH3-23_IGHD2-2*01 > 3'_IGHJ6*01 | 1782 | gnl\|Fabrus\|V2-14_IGLJ4*01 | 1118 |
| 4078 VH3-23_IGHD2-8*01 > 1'_IGHJ6*01 | 1783 | gnl\|Fabrus\|V2-14_IGLJ4*01 | 1118 |
| 4079 VH3-23_IGHD2-15*01 > 1'_IGHJ6*01 | 1784 | gnl\|Fabrus\|V2-14_IGLJ4*01 | 1118 |
| 4080 VH3-23_IGHD2-15*01 > 3'_IGHJ6*01 | 1785 | gnl\|Fabrus\|V2-14_IGLJ4*01 | 1118 |
| 4081 VH3-23_IGHD2-21*01 > 1'_IGHJ6*01 | 1786 | gnl\|Fabrus\|V2-14_IGLJ4*01 | 1118 |
| 4082 VH3-23_IGHD2-21*01 > 3'_IGHJ6*01 | 1787 | gnl\|Fabrus\|V2-14_IGLJ4*01 | 1118 |
| 4083 VH3-23_IGHD3-3*01 > 1'_IGHJ6*01 | 1788 | gnl\|Fabrus\|V2-14_IGLJ4*01 | 1118 |
| 4084 VH3-23_IGHD3-3*01 > 3'_IGHJ6*01 | 1789 | gnl\|Fabrus\|V2-14_IGLJ4*01 | 1118 |
| 4085 VH3-23_IGHD3-9*01 > 1'_IGHJ6*01 | 1790 | gnl\|Fabrus\|V2-14_IGLJ4*01 | 1118 |
| 4086 VH3-23_IGHD3-9*01 > 3'_IGHJ6*01 | 1791 | gnl\|Fabrus\|V2-14_IGLJ4*01 | 1118 |
| 4087 VH3-23_IGHD3-10*01 > 1'_IGHJ6*01 | 1792 | gnl\|Fabrus\|V2-14_IGLJ4*01 | 1118 |

TABLE 4-continued

Exemplary Paired Nucleic Acid Library

| HEAVY CHAIN | SEQ ID NO | LIGHT CHAIN | SEQ ID NO |
|---|---|---|---|
| 4088 VH3-23_IGHD3-10*01 > 3'_IGHJ6*01 | 1793 | gnl|Fabrus|V2-14_IGLJ4*01 | 1118 |
| 4089 VH3-23_IGHD3-16*01 > 1'_IGHJ6*01 | 1794 | gnl|Fabrus|V2-14_IGLJ4*01 | 1118 |
| 4090 VH3-23_IGHD3-16*01 > 3'_IGHJ6*01 | 1795 | gnl|Fabrus|V2-14_IGLJ4*01 | 1118 |
| 4091 VH3-23_IGHD3-22*01 > 1'_IGHJ6*01 | 1796 | gnl|Fabrus|V2-14_IGLJ4*01 | 1118 |
| 4092 VH3-23_IGHD4-4*01 (1) > 1'_IGHJ6*01 | 1797 | gnl|Fabrus|V2-14_IGLJ4*01 | 1118 |
| 4093 VH3-23_IGHD4-4*01 (1) > 3'_IGHJ6*01 | 1798 | gnl|Fabrus|V2-14_IGLJ4*01 | 1118 |
| 4094 VH3-23_IGHD4-11*01 (1) > 1'_IGHJ6*01 | 1799 | gnl|Fabrus|V2-14_IGLJ4*01 | 1118 |
| 4095 VH3-23_IGHD4-11*01 (1) > 3'_IGHJ6*01 | 1800 | gnl|Fabrus|V2-14_IGLJ4*01 | 1118 |
| 4096 VH3-23_IGHD4-17*01 > 1'_IGHJ6*01 | 1801 | gnl|Fabrus|V2-14_IGLJ4*01 | 1118 |
| 4097 VH3-23_IGHD4-17*01 > 3'_IGHJ6*01 | 1802 | gnl|Fabrus|V2-14_IGLJ4*01 | 1118 |
| 4098 VH3-23_IGHD4-23*01 > 1'_IGHJ6*01 | 1803 | gnl|Fabrus|V2-14_IGLJ4*01 | 1118 |
| 4099 VH3-23_IGHD4-23*01 > 3'_IGHJ6*01 | 1804 | gnl|Fabrus|V2-14_IGLJ4*01 | 1118 |
| 4100 VH3-23_IGHD5-5*01 (2) > 1'_IGHJ6*01 | 1805 | gnl|Fabrus|V2-14_IGLJ4*01 | 1118 |
| 4101 VH3-23_IGHD5-5*01 (2) > 3'_IGHJ6*01 | 1806 | gnl|Fabrus|V2-14_IGLJ4*01 | 1118 |
| 4102 VH3-23_IGHD5-12*01 > 1'_IGHJ6*01 | 1807 | gnl|Fabrus|V2-14_IGLJ4*01 | 1118 |
| 4103 VH3-23_IGHD5-12*01 > 3'_IGHJ6*01 | 1808 | gnl|Fabrus|V2-14_IGLJ4*01 | 1118 |
| 4104 VH3-23_IGHD5-18*01 (2) > 1'_IGHJ6*01 | 1809 | gnl|Fabrus|V2-14_IGLJ4*01 | 1118 |
| 4105 VH3-23_IGHD5-18*01 (2) > 3'_IGHJ6*01 | 1810 | gnl|Fabrus|V2-14_IGLJ4*01 | 1118 |
| 4106 VH3-23_IGHD5-24*01 > 1'_IGHJ6*01 | 1811 | gnl|Fabrus|V2-14_IGLJ4*01 | 1118 |
| 4107 VH3-23_IGHD5-24*01 > 3'_IGHJ6*01 | 1812 | gnl|Fabrus|V2-14_IGLJ4*01 | 1118 |
| 4108 VH3-23_IGHD6-6*01 > 1'_IGHJ6*01 | 1813 | gnl|Fabrus|V2-14_IGLJ4*01 | 1118 |
| 4109 VH3-23_IGHD6-6*01 > 2'_IGHJ6*01 | 1814 | gnl|Fabrus|V2-14_IGLJ4*01 | 1118 |
| 4110 VH3-23_IGHD6-6*01 > 3'_IGHJ6*01 | 1815 | gnl|Fabrus|V2-14_IGLJ4*01 | 1118 |
| 4111 VH3-23_IGHD1-1*01 > 1_IGHJ6*01 | 1711 | gnl|Fabrus|V2-15_IGLJ7*01 | 1118 |
| 4112 VH3-23_IGHD1-1*01 > 2_IGHJ6*01 | 1712 | gnl|Fabrus|V2-15_IGLJ7*01 | 1119 |
| 4113 VH3-23_IGHD1-1*01 > 3_IGHJ6*01 | 1713 | gnl|Fabrus|V2-15_IGLJ7*01 | 1119 |
| 4114 VH3-23_IGHD1-7*01 > 1_IGHJ6*01 | 1714 | gnl|Fabrus|V2-15_IGLJ7*01 | 1119 |
| 4115 VH3-23_IGHD1-7*01 > 3_IGHJ6*01 | 1715 | gnl|Fabrus|V2-15_IGLJ7*01 | 1119 |
| 4116 VH3-23_IGHD1-14*01 > 1_IGHJ6*01 | 1716 | gnl|Fabrus|V2-15_IGLJ7*01 | 1119 |
| 4117 VH3-23_IGHD1-14*01 > 3_IGHJ6*01 | 1717 | gnl|Fabrus|V2-15_IGLJ7*01 | 1119 |
| 4118 VH3-23_IGHD1-20*01 > 1_IGHJ6*01 | 1718 | gnl|Fabrus|V2-15_IGLJ7*01 | 1119 |
| 4119 VH3-23_IGHD1-20*01 > 3_IGHJ6*01 | 1719 | gnl|Fabrus|V2-15_IGLJ7*01 | 1119 |
| 4120 VH3-23_IGHD1-26*01 > 1_IGHJ6*01 | 1720 | gnl|Fabrus|V2-15_IGLJ7*01 | 1119 |
| 4121 VH3-23_IGHD1-26*01 > 3_IGHJ6*01 | 1721 | gnl|Fabrus|V2-15_IGLJ7*01 | 1119 |
| 4122 VH3-23_IGHD2-2*01 > 2_IGHJ6*01 | 1722 | gnl|Fabrus|V2-15_IGLJ7*01 | 1119 |
| 4123 VH3-23_IGHD2-2*01 > 3_IGHJ6*01 | 1723 | gnl|Fabrus|V2-15_IGLJ7*01 | 1119 |
| 4124 VH3-23_IGHD2-8*01 > 2_IGHJ6*01 | 1724 | gnl|Fabrus|V2-15_IGLJ7*01 | 1119 |
| 4125 VH3-23_IGHD2-8*01 > 3_IGHJ6*01 | 1725 | gnl|Fabrus|V2-15_IGLJ7*01 | 1119 |
| 4126 VH3-23_IGHD2-15*01 > 2_IGHJ6*01 | 1726 | gnl|Fabrus|V2-15_IGLJ7*01 | 1119 |
| 4127 VH3-23_IGHD2-15*01 > 3_IGHJ6*01 | 1727 | gnl|Fabrus|V2-15_IGLJ7*01 | 1119 |
| 4128 VH3-23_IGHD2-21*01 > 2_IGHJ6*01 | 1728 | gnl|Fabrus|V2-15_IGLJ7*01 | 1119 |
| 4129 VH3-23_IGHD2-21*01 > 3_IGHJ6*01 | 1729 | gnl|Fabrus|V2-15_IGLJ7*01 | 1119 |
| 4130 VH3-23_IGHD3-3*01 > 1_IGHJ6*01 | 1730 | gnl|Fabrus|V2-15_IGLJ7*01 | 1119 |
| 4131 VH3-23_IGHD3-3*01 > 2_IGHJ6*01 | 1731 | gnl|Fabrus|V2-15_IGLJ7*01 | 1119 |
| 4132 VH3-23_IGHD3-3*01 > 3_IGHJ6*01 | 1732 | gnl|Fabrus|V2-15_IGLJ7*01 | 1119 |
| 4133 VH3-23_IGHD3-9*01 > 2_IGHJ6*01 | 1733 | gnl|Fabrus|V2-15_IGLJ7*01 | 1119 |
| 4134 VH3-23_IGHD3-10*01 > 2_IGHJ6*01 | 1734 | gnl|Fabrus|V2-15_IGLJ7*01 | 1119 |
| 4135 VH3-23_IGHD3-10*01 > 3_IGHJ6*01 | 1735 | gnl|Fabrus|V2-15_IGLJ7*01 | 1119 |
| 4136 VH3-23_IGHD3-16*01 > 2_IGHJ6*01 | 1736 | gnl|Fabrus|V2-15_IGLJ7*01 | 1119 |
| 4137 VH3-23_IGHD3-16*01 > 3_IGHJ6*01 | 1737 | gnl|Fabrus|V2-15_IGLJ7*01 | 1119 |
| 4138 VH3-23_IGHD3-22*01 > 2_IGHJ6*01 | 1738 | gnl|Fabrus|V2-15_IGLJ7*01 | 1119 |
| 4139 VH3-23_IGHD3-22*01 > 3_IGHJ6*01 | 1739 | gnl|Fabrus|V2-15_IGLJ7*01 | 1119 |
| 4140 VH3-23_IGHD4-4*01 (1) > 2_IGHJ6*01 | 1740 | gnl|Fabrus|V2-15_IGLJ7*01 | 1119 |
| 4141 VH3-23_IGHD4-4*01 (1) > 3_IGHJ6*01 | 1741 | gnl|Fabrus|V2-15_IGLJ7*01 | 1119 |
| 4142 VH3-23_IGHD4-11*01 (1) > 2_IGHJ6*01 | 1742 | gnl|Fabrus|V2-15_IGLJ7*01 | 1119 |
| 4143 VH3-23_IGHD4-11*01 (1) > 3_IGHJ6*01 | 1743 | gnl|Fabrus|V2-15_IGLJ7*01 | 1119 |
| 4144 VH3-23_IGHD4-17*01 > 2_IGHJ6*01 | 1744 | gnl|Fabrus|V2-15_IGLJ7*01 | 1119 |
| 4145 VH3-23_IGHD4-17*01 > 3_IGHJ6*01 | 1745 | gnl|Fabrus|V2-15_IGLJ7*01 | 1119 |
| 4146 VH3-23_IGHD4-23*01 > 2_IGHJ6*01 | 1746 | gnl|Fabrus|V2-15_IGLJ7*01 | 1119 |
| 4147 VH3-23_IGHD4-23*01 > 3_IGHJ6*01 | 1747 | gnl|Fabrus|V2-15_IGLJ7*01 | 1119 |
| 4148 VH3-23_IGHD5-5*01 (2) > 1_IGHJ6*01 | 1748 | gnl|Fabrus|V2-15_IGLJ7*01 | 1119 |
| 4149 VH3-23_IGHD5-5*01 (2) > 2_IGHJ6*01 | 1749 | gnl|Fabrus|V2-15_IGLJ7*01 | 1119 |
| 4150 VH3-23_IGHD5-5*01 (2) > 3_IGHJ6*01 | 1750 | gnl|Fabrus|V2-15_IGLJ7*01 | 1119 |
| 4151 VH3-23_IGHD5-12*01 > 1_IGHJ6*01 | 1751 | gnl|Fabrus|V2-15_IGLJ7*01 | 1119 |
| 4152 VH3-23_IGHD5-12*01 > 3_IGHJ6*01 | 1752 | gnl|Fabrus|V2-15_IGLJ7*01 | 1119 |
| 4153 VH3-23_IGHD5-18*01 (2) > 1_IGHJ6*01 | 1753 | gnl|Fabrus|V2-15_IGLJ7*01 | 1119 |
| 4154 VH3-23_IGHD5-18*01 (2) > 2_IGHJ6*01 | 1754 | gnl|Fabrus|V2-15_IGLJ7*01 | 1119 |
| 4155 VH3-23_IGHD5-18*01 (2) > 3_IGHJ6*01 | 1755 | gnl|Fabrus|V2-15_IGLJ7*01 | 1119 |
| 4156 VH3-23_IGHD5-24*01 > 1_IGHJ6*01 | 1756 | gnl|Fabrus|V2-15_IGLJ7*01 | 1119 |
| 4157 VH3-23_IGHD5-24*01 > 3_IGHJ6*01 | 1757 | gnl|Fabrus|V2-15_IGLJ7*01 | 1119 |
| 4158 VH3-23_IGHD6-6*01 > 1_IGHJ6*01 | 1758 | gnl|Fabrus|V2-15_IGLJ7*01 | 1119 |
| 4159 VH3-23_IGHD1-1*01 > 1'_IGHJ6*01 | 1768 | gnl|Fabrus|V2-15_IGLJ7*01 | 1119 |
| 4160 VH3-23_IGHD1-1*01 > 2'_IGHJ6*01 | 1769 | gnl|Fabrus|V2-15_IGLJ7*01 | 1119 |
| 4161 VH3-23_IGHD1-1*01 > 3'_IGHJ6*01 | 1770 | gnl|Fabrus|V2-15_IGLJ7*01 | 1119 |

TABLE 4-continued

Exemplary Paired Nucleic Acid Library

| HEAVY CHAIN | SEQ ID NO | LIGHT CHAIN | SEQ ID NO |
|---|---|---|---|
| 4162 VH3-23_IGHD1-7*01 > 1'_IGHJ6*01 | 1771 | gnl\|Fabrus\|V2-15_IGLJ7*01 | 1119 |
| 4163 VH3-23_IGHD1-7*01 > 3'_IGHJ6*01 | 1772 | gnl\|Fabrus\|V2-15_IGLJ7*01 | 1119 |
| 4164 VH3-23_IGHD1-14*01 > 1'_IGHJ6*01 | 1773 | gnl\|Fabrus\|V2-15_IGLJ7*01 | 1119 |
| 4165 VH3-23_IGHD1-14*01 > 2'_IGHJ6*01 | 1774 | gnl\|Fabrus\|V2-15_IGLJ7*01 | 1119 |
| 4166 VH3-23_IGHD1-14*01 > 3'_IGHJ6*01 | 1775 | gnl\|Fabrus\|V2-15_IGLJ7*01 | 1119 |
| 4167 VH3-23_IGHD1-20*01 > 1'_IGHJ6*01 | 1776 | gnl\|Fabrus\|V2-15_IGLJ7*01 | 1119 |
| 4168 VH3-23_IGHD1-20*01 > 2'_IGHJ6*01 | 1777 | gnl\|Fabrus\|V2-15_IGLJ7*01 | 1119 |
| 4169 VH3-23_IGHD1-20*01 > 3'_IGHJ6*01 | 1778 | gnl\|Fabrus\|V2-15_IGLJ7*01 | 1119 |
| 4170 VH3-23_IGHD1-26*01 > 1'_IGHJ6*01 | 1779 | gnl\|Fabrus\|V2-15_IGLJ7*01 | 1119 |
| 4171 VH3-23_IGHD1-26*01 > 1_IGHJ6*01_B | 1780 | gnl\|Fabrus\|V2-15_IGLJ7*01 | 1119 |
| 4172 VH3-23_IGHD2-2*01 > 2_IGHJ6*01_B | 1781 | gnl\|Fabrus\|V2-15_IGLJ7*01 | 1119 |
| 4173 VH3-23_IGHD2-2*01 > 3'_IGHJ6*01 | 1782 | gnl\|Fabrus\|V2-15_IGLJ7*01 | 1119 |
| 4174 VH3-23_IGHD2-8*01 > 1'_IGHJ6*01 | 1783 | gnl\|Fabrus\|V2-15_IGLJ7*01 | 1119 |
| 4175 VH3-23_IGHD2-15*01 > 1'_IGHJ6*01 | 1784 | gnl\|Fabrus\|V2-15_IGLJ7*01 | 1119 |
| 4176 VH3-23_IGHD2-15*01 > 3'_IGHJ6*01 | 1785 | gnl\|Fabrus\|V2-15_IGLJ7*01 | 1119 |
| 4177 VH3-23_IGHD2-21*01 > 1'_IGHJ6*01 | 1786 | gnl\|Fabrus\|V2-15_IGLJ7*01 | 1119 |
| 4178 VH3-23_IGHD2-21*01 > 3'_IGHJ6*01 | 1787 | gnl\|Fabrus\|V2-15_IGLJ7*01 | 1119 |
| 4179 VH3-23_IGHD3-3*01 > 1'_IGHJ6*01 | 1788 | gnl\|Fabrus\|V2-15_IGLJ7*01 | 1119 |
| 4180 VH3-23_IGHD3-3*01 > 3'_IGHJ6*01 | 1789 | gnl\|Fabrus\|V2-15_IGLJ7*01 | 1119 |
| 4181 VH3-23_IGHD3-9*01 > 1'_IGHJ6*01 | 1790 | gnl\|Fabrus\|V2-15_IGLJ7*01 | 1119 |
| 4182 VH3-23_IGHD3-9*01 > 3'_IGHJ6*01 | 1791 | gnl\|Fabrus\|V2-15_IGLJ7*01 | 1119 |
| 4183 VH3-23_IGHD3-10*01 > 1'_IGHJ6*01 | 1792 | gnl\|Fabrus\|V2-15_IGLJ7*01 | 1119 |
| 4184 VH3-23_IGHD3-10*01 > 3'_IGHJ6*01 | 1793 | gnl\|Fabrus\|V2-15_IGLJ7*01 | 1119 |
| 4185 VH3-23_IGHD3-16*01 > 1'_IGHJ6*01 | 1794 | gnl\|Fabrus\|V2-15_IGLJ7*01 | 1119 |
| 4186 VH3-23_IGHD3-16*01 > 3'_IGHJ6*01 | 1795 | gnl\|Fabrus\|V2-15_IGLJ7*01 | 1119 |
| 4187 VH3-23_IGHD3-22*01 > 1'_IGHJ6*01 | 1796 | gnl\|Fabrus\|V2-15_IGLJ7*01 | 1119 |
| 4188 VH3-23_IGHD4-4*01 (1) > 1'_IGHJ6*01 | 1797 | gnl\|Fabrus\|V2-15_IGLJ7*01 | 1119 |
| 4189 VH3-23_IGHD4-4*01 (1) > 3'_IGHJ6*01 | 1798 | gnl\|Fabrus\|V2-15_IGLJ7*01 | 1119 |
| 4190 VH3-23_IGHD4-11*01 (1) > 1'_IGHJ6*01 | 1799 | gnl\|Fabrus\|V2-15_IGLJ7*01 | 1119 |
| 4191 VH3-23_IGHD4-11*01 (1) > 3'_IGHJ6*01 | 1800 | gnl\|Fabrus\|V2-15_IGLJ7*01 | 1119 |
| 4192 VH3-23_IGHD4-17*01 > 1'_IGHJ6*01 | 1801 | gnl\|Fabrus\|V2-15_IGLJ7*01 | 1119 |
| 4193 VH3-23_IGHD4-17*01 > 3'_IGHJ6*01 | 1802 | gnl\|Fabrus\|V2-15_IGLJ7*01 | 1119 |
| 4194 VH3-23_IGHD4-23*01 > 1'_IGHJ6*01 | 1803 | gnl\|Fabrus\|V2-15_IGLJ7*01 | 1119 |
| 4195 VH3-23_IGHD4-23*01 > 3'_IGHJ6*01 | 1804 | gnl\|Fabrus\|V2-15_IGLJ7*01 | 1119 |
| 4196 VH3-23_IGHD5-5*01 (2) > 1'_IGHJ6*01 | 1805 | gnl\|Fabrus\|V2-15_IGLJ7*01 | 1119 |
| 4197 VH3-23_IGHD5-5*01 (2) > 3'_IGHJ6*01 | 1806 | gnl\|Fabrus\|V2-15_IGLJ7*01 | 1119 |
| 4198 VH3-23_IGHD5-12*01 > 1'_IGHJ6*01 | 1807 | gnl\|Fabrus\|V2-15_IGLJ7*01 | 1119 |
| 4199 VH3-23_IGHD5-12*01 > 3'_IGHJ6*01 | 1808 | gnl\|Fabrus\|V2-15_IGLJ7*01 | 1119 |
| 4200 VH3-23_IGHD5-18*01 (2) > 1'_IGHJ6*01 | 1809 | gnl\|Fabrus\|V2-15_IGLJ7*01 | 1119 |
| 4201 VH3-23_IGHD5-18*01 (2) > 3'_IGHJ6*01 | 1810 | gnl\|Fabrus\|V2-15_IGLJ7*01 | 1119 |
| 4202 VH3-23_IGHD5-24*01 > 1'_IGHJ6*01 | 1811 | gnl\|Fabrus\|V2-15_IGLJ7*01 | 1119 |
| 4203 VH3-23_IGHD5-24*01 > 3'_IGHJ6*01 | 1812 | gnl\|Fabrus\|V2-15_IGLJ7*01 | 1119 |
| 4204 VH3-23_IGHD6-6*01 > 1'_IGHJ6*01 | 1813 | gnl\|Fabrus\|V2-15_IGLJ7*01 | 1119 |
| 4205 VH3-23_IGHD6-6*01 > 2'_IGHJ6*01 | 1814 | gnl\|Fabrus\|V2-15_IGLJ7*01 | 1119 |
| 4206 VH3-23_IGHD6-6*01 > 3'_IGHJ6*01 | 1815 | gnl\|Fabrus\|V2-15_IGLJ7*01 | 1119 |
| 4207 VH3-23_IGHD1-1*01 > 1_IGHJ6*01 | 1711 | gnl\|Fabrus\|V2-17_IGLJ2*01 | 1120 |
| 4208 VH3-23_IGHD1-1*01 > 2_IGHJ6*01 | 1712 | gnl\|Fabrus\|V2-17_IGLJ2*01 | 1120 |
| 4209 VH3-23_IGHD1-1*01 > 3_IGHJ6*01 | 1713 | gnl\|Fabrus\|V2-17_IGLJ2*01 | 1120 |
| 4210 VH3-23_IGHD1-7*01 > 1_IGHJ6*01 | 1714 | gnl\|Fabrus\|V2-17_IGLJ2*01 | 1120 |
| 4211 VH3-23_IGHD1-7*01 > 3_IGHJ6*01 | 1715 | gnl\|Fabrus\|V2-17_IGLJ2*01 | 1120 |
| 4212 VH3-23_IGHD1-14*01 > 1_IGHJ6*01 | 1716 | gnl\|Fabrus\|V2-17_IGLJ2*01 | 1120 |
| 4213 VH3-23_IGHD1-14*01 > 3_IGHJ6*01 | 1717 | gnl\|Fabrus\|V2-17_IGLJ2*01 | 1120 |
| 4214 VH3-23_IGHD1-20*01 > 1_IGHJ6*01 | 1718 | gnl\|Fabrus\|V2-17_IGLJ2*01 | 1120 |
| 4215 VH3-23_IGHD1-20*01 > 3_IGHJ6*01 | 1719 | gnl\|Fabrus\|V2-17_IGLJ2*01 | 1120 |
| 4216 VH3-23_IGHD1-26*01 > 1_IGHJ6*01 | 1720 | gnl\|Fabrus\|V2-17_IGLJ2*01 | 1120 |
| 4217 VH3-23_IGHD1-26*01 > 3_IGHJ6*01 | 1721 | gnl\|Fabrus\|V2-17_IGLJ2*01 | 1120 |
| 4218 VH3-23_IGHD2-2*01 > 2_IGHJ6*01 | 1722 | gnl\|Fabrus\|V2-17_IGLJ2*01 | 1120 |
| 4219 VH3-23_IGHD2-2*01 > 3_IGHJ6*01 | 1723 | gnl\|Fabrus\|V2-17_IGLJ2*01 | 1120 |
| 4220 VH3-23_IGHD2-8*01 > 2_IGHJ6*01 | 1724 | gnl\|Fabrus\|V2-17_IGLJ2*01 | 1120 |
| 4221 VH3-23_IGHD2-8*01 > 3_IGHJ6*01 | 1725 | gnl\|Fabrus\|V2-17_IGLJ2*01 | 1120 |
| 4222 VH3-23_IGHD2-15*01 > 2_IGHJ6*01 | 1726 | gnl\|Fabrus\|V2-17_IGLJ2*01 | 1120 |
| 4223 VH3-23_IGHD2-15*01 > 3_IGHJ6*01 | 1727 | gnl\|Fabrus\|V2-17_IGLJ2*01 | 1120 |
| 4224 VH3-23_IGHD2-21*01 > 2_IGHJ6*01 | 1728 | gnl\|Fabrus\|V2-17_IGLJ2*01 | 1120 |
| 4225 VH3-23_IGHD2-21*01 > 3_IGHJ6*01 | 1729 | gnl\|Fabrus\|V2-17_IGLJ2*01 | 1120 |
| 4226 VH3-23_IGHD3-3*01 > 1_IGHJ6*01 | 1730 | gnl\|Fabrus\|V2-17_IGLJ2*01 | 1120 |
| 4227 VH3-23_IGHD3-3*01 > 2_IGHJ6*01 | 1731 | gnl\|Fabrus\|V2-17_IGLJ2*01 | 1120 |
| 4228 VH3-23_IGHD3-3*01 > 3_IGHJ6*01 | 1732 | gnl\|Fabrus\|V2-17_IGLJ2*01 | 1120 |
| 4229 VH3-23_IGHD3-9*01 > 2_IGHJ6*01 | 1733 | gnl\|Fabrus\|V2-17_IGLJ2*01 | 1120 |
| 4230 VH3-23_IGHD3-10*01 > 2_IGHJ6*01 | 1734 | gnl\|Fabrus\|V2-17_IGLJ2*01 | 1120 |
| 4231 VH3-23_IGHD3-10*01 > 3_IGHJ6*01 | 1735 | gnl\|Fabrus\|V2-17_IGLJ2*01 | 1120 |
| 4232 VH3-23_IGHD3-16*01 > 2_IGHJ6*01 | 1736 | gnl\|Fabrus\|V2-17_IGLJ2*01 | 1120 |
| 4233 VH3-23_IGHD3-16*01 > 3_IGHJ6*01 | 1737 | gnl\|Fabrus\|V2-17_IGLJ2*01 | 1120 |
| 4234 VH3-23_IGHD3-22*01 > 2_IGHJ6*01 | 1738 | gnl\|Fabrus\|V2-17_IGLJ2*01 | 1120 |
| 4235 VH3-23_IGHD3-22*01 > 3_IGHJ6*01 | 1739 | gnl\|Fabrus\|V2-17_IGLJ2*01 | 1120 |

TABLE 4-continued

Exemplary Paired Nucleic Acid Library

| HEAVY CHAIN | SEQ ID NO | LIGHT CHAIN | SEQ ID NO |
|---|---|---|---|
| 4236 VH3-23_IGHD4-4*01 (1) > 2_IGHJ6*01 | 1740 | gnl\|Fabrus\|V2-17_IGLJ2*01 | 1120 |
| 4237 VH3-23_IGHD4-4*01 (1) > 3_IGHJ6*01 | 1741 | gnl\|Fabrus\|V2-17_IGLJ2*01 | 1120 |
| 4238 VH3-23_IGHD4-11*01 (1) > 2_IGHJ6*01 | 1742 | gnl\|Fabrus\|V2-17_IGLJ2*01 | 1120 |
| 4239 VH3-23_IGHD4-11*01 (1) > 3_IGHJ6*01 | 1743 | gnl\|Fabrus\|V2-17_IGLJ2*01 | 1120 |
| 4240 VH3-23_IGHD4-17*01 > 2_IGHJ6*01 | 1744 | gnl\|Fabrus\|V2-17_IGLJ2*01 | 1120 |
| 4241 VH3-23_IGHD4-17*01 > 3_IGHJ6*01 | 1745 | gnl\|Fabrus\|V2-17_IGLJ2*01 | 1120 |
| 4242 VH3-23_IGHD4-23*01 > 2_IGHJ6*01 | 1746 | gnl\|Fabrus\|V2-17_IGLJ2*01 | 1120 |
| 4243 VH3-23_IGHD4-23*01 > 3_IGHJ6*01 | 1747 | gnl\|Fabrus\|V2-17_IGLJ2*01 | 1120 |
| 4244 VH3-23_IGHD5-5*01 (2) > 1_IGHJ6*01 | 1748 | gnl\|Fabrus\|V2-17_IGLJ2*01 | 1120 |
| 4245 VH3-23_IGHD5-5*01 (2) > 2_IGHJ6*01 | 1749 | gnl\|Fabrus\|V2-17_IGLJ2*01 | 1120 |
| 4246 VH3-23_IGHD5-5*01 (2) > 3_IGHJ6*01 | 1750 | gnl\|Fabrus\|V2-17_IGLJ2*01 | 1120 |
| 4247 VH3-23_IGHD5-12*01 > 1_IGHJ6*01 | 1751 | gnl\|Fabrus\|V2-17_IGLJ2*01 | 1120 |
| 4248 VH3-23_IGHD5-12*01 > 3_IGHJ6*01 | 1752 | gnl\|Fabrus\|V2-17_IGLJ2*01 | 1120 |
| 4249 VH3-23_IGHD5-18*01 (2) > 1_IGHJ6*01 | 1753 | gnl\|Fabrus\|V2-17_IGLJ2*01 | 1120 |
| 4250 VH3-23_IGHD5-18*01 (2) > 2_IGHJ6*01 | 1754 | gnl\|Fabrus\|V2-17_IGLJ2*01 | 1120 |
| 4251 VH3-23_IGHD5-18*01 (2) > 3_IGHJ6*01 | 1755 | gnl\|Fabrus\|V2-17_IGLJ2*01 | 1120 |
| 4252 VH3-23_IGHD5-24*01 > 1_IGHJ6*01 | 1756 | gnl\|Fabrus\|V2-17_IGLJ2*01 | 1120 |
| 4253 VH3-23_IGHD5-24*01 > 3_IGHJ6*01 | 1757 | gnl\|Fabrus\|V2-17_IGLJ2*01 | 1120 |
| 4254 VH3-23_IGHD6-6*01 > 1_IGHJ6*01 | 1758 | gnl\|Fabrus\|V2-17_IGLJ2*01 | 1120 |
| 4255 VH3-23_IGHD1-1*01 > 1'_IGHJ6*01 | 1768 | gnl\|Fabrus\|V2-17_IGLJ2*01 | 1120 |
| 4256 VH3-23_IGHD1-1*01 > 2'_IGHJ6*01 | 1769 | gnl\|Fabrus\|V2-17_IGLJ2*01 | 1120 |
| 4257 VH3-23_IGHD1-1*01 > 3'_IGHJ6*01 | 1770 | gnl\|Fabrus\|V2-17_IGLJ2*01 | 1120 |
| 4258 VH3-23_IGHD1-7*01 > 1'_IGHJ6*01 | 1771 | gnl\|Fabrus\|V2-17_IGLJ2*01 | 1120 |
| 4259 VH3-23_IGHD1-7*01 > 3'_IGHJ6*01 | 1772 | gnl\|Fabrus\|V2-17_IGLJ2*01 | 1120 |
| 4260 VH3-23_IGHD1-14*01 > 1'_IGHJ6*01 | 1773 | gnl\|Fabrus\|V2-17_IGLJ2*01 | 1120 |
| 4261 VH3-23_IGHD1-14*01 > 2'_IGHJ6*01 | 1774 | gnl\|Fabrus\|V2-17_IGLJ2*01 | 1120 |
| 4262 VH3-23_IGHD1-14*01 > 3'_IGHJ6*01 | 1775 | gnl\|Fabrus\|V2-17_IGLJ2*01 | 1120 |
| 4263 VH3-23_IGHD1-20*01 > 1'_IGHJ6*01 | 1776 | gnl\|Fabrus\|V2-17_IGLJ2*01 | 1120 |
| 4264 VH3-23_IGHD1-20*01 > 2'_IGHJ6*01 | 1777 | gnl\|Fabrus\|V2-17_IGLJ2*01 | 1120 |
| 4265 VH3-23_IGHD1-20*01 > 3'_IGHJ6*01 | 1778 | gnl\|Fabrus\|V2-17_IGLJ2*01 | 1120 |
| 4266 VH3-23_IGHD1-26*01 > 1'_IGHJ6*01 | 1779 | gnl\|Fabrus\|V2-17_IGLJ2*01 | 1120 |
| 4267 VH3-23_IGHD1-26*01 > 1_IGHJ6*01_B | 1780 | gnl\|Fabrus\|V2-17_IGLJ2*01 | 1120 |
| 4268 VH3-23_IGHD2-2*01 > 2_IGHJ6*01_B | 1781 | gnl\|Fabrus\|V2-17_IGLJ2*01 | 1120 |
| 4269 VH3-23_IGHD2-2*01 > 3'_IGHJ6*01 | 1782 | gnl\|Fabrus\|V2-17_IGLJ2*01 | 1120 |
| 4270 VH3-23_IGHD2-8*01 > 1'_IGHJ6*01 | 1783 | gnl\|Fabrus\|V2-17_IGLJ2*01 | 1120 |
| 4271 VH3-23_IGHD2-15*01 > 1'_IGHJ6*01 | 1784 | gnl\|Fabrus\|V2-17_IGLJ2*01 | 1120 |
| 4272 VH3-23_IGHD2-15*01 > 3'_IGHJ6*01 | 1785 | gnl\|Fabrus\|V2-17_IGLJ2*01 | 1120 |
| 4273 VH3-23_IGHD2-21*01 > 1'_IGHJ6*01 | 1786 | gnl\|Fabrus\|V2-17_IGLJ2*01 | 1120 |
| 4274 VH3-23_IGHD2-21*01 > 3'_IGHJ6*01 | 1787 | gnl\|Fabrus\|V2-17_IGLJ2*01 | 1120 |
| 4275 VH3-23_IGHD3-3*01 > 1'_IGHJ6*01 | 1788 | gnl\|Fabrus\|V2-17_IGLJ2*01 | 1120 |
| 4276 VH3-23_IGHD3-3*01 > 3'_IGHJ6*01 | 1789 | gnl\|Fabrus\|V2-17_IGLJ2*01 | 1120 |
| 4277 VH3-23_IGHD3-9*01 > 1'_IGHJ6*01 | 1790 | gnl\|Fabrus\|V2-17_IGLJ2*01 | 1120 |
| 4278 VH3-23_IGHD3-9*01 > 3'_IGHJ6*01 | 1791 | gnl\|Fabrus\|V2-17_IGLJ2*01 | 1120 |
| 4279 VH3-23_IGHD3-10*01 > 1'_IGHJ6*01 | 1792 | gnl\|Fabrus\|V2-17_IGLJ2*01 | 1120 |
| 4280 VH3-23_IGHD3-10*01 > 3'_IGHJ6*01 | 1793 | gnl\|Fabrus\|V2-17_IGLJ2*01 | 1120 |
| 4281 VH3-23_IGHD3-16*01 > 1'_IGHJ6*01 | 1794 | gnl\|Fabrus\|V2-17_IGLJ2*01 | 1120 |
| 4282 VH3-23_IGHD3-16*01 > 3'_IGHJ6*01 | 1795 | gnl\|Fabrus\|V2-17_IGLJ2*01 | 1120 |
| 4283 VH3-23_IGHD3-22*01 > 1'_IGHJ6*01 | 1796 | gnl\|Fabrus\|V2-17_IGLJ2*01 | 1120 |
| 4284 VH3-23_IGHD4-4*01 (1) > 1'_IGHJ6*01 | 1797 | gnl\|Fabrus\|V2-17_IGLJ2*01 | 1120 |
| 4285 VH3-23_IGHD4-4*01 (1) > 3'_IGHJ6*01 | 1798 | gnl\|Fabrus\|V2-17_IGLJ2*01 | 1120 |
| 4286 VH3-23_IGHD4-11*01 (1) > 1'_IGHJ6*01 | 1799 | gnl\|Fabrus\|V2-17_IGLJ2*01 | 1120 |
| 4287 VH3-23_IGHD4-11*01 (1) > 3'_IGHJ6*01 | 1800 | gnl\|Fabrus\|V2-17_IGLJ2*01 | 1120 |
| 4288 VH3-23_IGHD4-17*01 > 1'_IGHJ6*01 | 1801 | gnl\|Fabrus\|V2-17_IGLJ2*01 | 1120 |
| 4289 VH3-23_IGHD4-17*01 > 3'_IGHJ6*01 | 1802 | gnl\|Fabrus\|V2-17_IGLJ2*01 | 1120 |
| 4290 VH3-23_IGHD4-23*01 > 1'_IGHJ6*01 | 1803 | gnl\|Fabrus\|V2-17_IGLJ2*01 | 1120 |
| 4291 VH3-23_IGHD4-23*01 > 3'_IGHJ6*01 | 1804 | gnl\|Fabrus\|V2-17_IGLJ2*01 | 1120 |
| 4292 VH3-23_IGHD5-5*01 (2) > 1'_IGHJ6*01 | 1805 | gnl\|Fabrus\|V2-17_IGLJ2*01 | 1120 |
| 4293 VH3-23_IGHD5-5*01 (2) > 3'_IGHJ6*01 | 1806 | gnl\|Fabrus\|V2-17_IGLJ2*01 | 1120 |
| 4294 VH3-23_IGHD5-12*01 > 1'_IGHJ6*01 | 1807 | gnl\|Fabrus\|V2-17_IGLJ2*01 | 1120 |
| 4295 VH3-23_IGHD5-12*01 > 3'_IGHJ6*01 | 1808 | gnl\|Fabrus\|V2-17_IGLJ2*01 | 1120 |
| 4296 VH3-23_IGHD5-18*01 (2) > 1'_IGHJ6*01 | 1809 | gnl\|Fabrus\|V2-17_IGLJ2*01 | 1120 |
| 4297 VH3-23_IGHD5-18*01 (2) > 3'_IGHJ6*01 | 1810 | gnl\|Fabrus\|V2-17_IGLJ2*01 | 1120 |
| 4298 VH3-23_IGHD5-24*01 > 1'_IGHJ6*01 | 1811 | gnl\|Fabrus\|V2-17_IGLJ2*01 | 1120 |
| 4299 VH3-23_IGHD5-24*01 > 3'_IGHJ6*01 | 1812 | gnl\|Fabrus\|V2-17_IGLJ2*01 | 1120 |
| 4300 VH3-23_IGHD6-6*01 > 1'_IGHJ6*01 | 1813 | gnl\|Fabrus\|V2-17_IGLJ2*01 | 1120 |
| 4301 VH3-23_IGHD6-6*01 > 2'_IGHJ6*01 | 1814 | gnl\|Fabrus\|V2-17_IGLJ2*01 | 1120 |
| 4302 VH3-23_IGHD6-6*01 > 3'_IGHJ6*01 | 1815 | gnl\|Fabrus\|V2-17_IGLJ2*01 | 1120 |
| 4303 VH3-23_IGHD1-1*01 > 1_IGHJ6*01 | 1711 | gnl\|Fabrus\|V2-6_IGLJ4*01 | 1122 |
| 4304 VH3-23_IGHD1-1*01 > 2_IGHJ6*01 | 1712 | gnl\|Fabrus\|V2-6_IGLJ4*01 | 1122 |
| 4305 VH3-23_IGHD1-1*01 > 3_IGHJ6*01 | 1713 | gnl\|Fabrus\|V2-6_IGLJ4*01 | 1122 |
| 4306 VH3-23_IGHD1-7*01 > 1_IGHJ6*01 | 1714 | gnl\|Fabrus\|V2-6_IGLJ4*01 | 1122 |
| 4307 VH3-23_IGHD1-7*01 > 3_IGHJ6*01 | 1715 | gnl\|Fabrus\|V2-6_IGLJ4*01 | 1122 |
| 4308 VH3-23_IGHD1-14*01 > 1_IGHJ6*01 | 1716 | gnl\|Fabrus\|V2-6_IGLJ4*01 | 1122 |
| 4309 VH3-23_IGHD1-14*01 > 3_IGHJ6*01 | 1717 | gnl\|Fabrus\|V2-6_IGLJ4*01 | 1122 |

TABLE 4-continued

Exemplary Paired Nucleic Acid Library

| HEAVY CHAIN | SEQ ID NO | LIGHT CHAIN | SEQ ID NO |
|---|---|---|---|
| 4310 VH3-23_IGHD1-20*01 > 1_IGHJ6*01 | 1718 | gnl|Fabrus|V2-6_IGLJ4*01 | 1122 |
| 4311 VH3-23_IGHD1-20*01 > 3_IGHJ6*01 | 1719 | gnl|Fabrus|V2-6_IGLJ4*01 | 1122 |
| 4312 VH3-23_IGHD1-26*01 > 1_IGHJ6*01 | 1720 | gnl|Fabrus|V2-6_IGLJ4*01 | 1122 |
| 4313 VH3-23_IGHD1-26*01 > 3_IGHJ6*01 | 1721 | gnl|Fabrus|V2-6_IGLJ4*01 | 1122 |
| 4314 VH3-23_IGHD2-2*01 > 2_IGHJ6*01 | 1722 | gnl|Fabrus|V2-6_IGLJ4*01 | 1122 |
| 4315 VH3-23_IGHD2-2*01 > 3_IGHJ6*01 | 1723 | gnl|Fabrus|V2-6_IGLJ4*01 | 1122 |
| 4316 VH3-23_IGHD2-8*01 > 2_IGHJ6*01 | 1724 | gnl|Fabrus|V2-6_IGLJ4*01 | 1122 |
| 4317 VH3-23_IGHD2-8*01 > 3_IGHJ6*01 | 1725 | gnl|Fabrus|V2-6_IGLJ4*01 | 1122 |
| 4318 VH3-23_IGHD2-15*01 > 2_IGHJ6*01 | 1726 | gnl|Fabrus|V2-6_IGLJ4*01 | 1122 |
| 4319 VH3-23_IGHD2-15*01 > 3_IGHJ6*01 | 1727 | gnl|Fabrus|V2-6_IGLJ4*01 | 1122 |
| 4320 VH3-23_IGHD2-21*01 > 2_IGHJ6*01 | 1728 | gnl|Fabrus|V2-6_IGLJ4*01 | 1122 |
| 4321 VH3-23_IGHD2-21*01 > 3_IGHJ6*01 | 1729 | gnl|Fabrus|V2-6_IGLJ4*01 | 1122 |
| 4322 VH3-23_IGHD3-3*01 > 1_IGHJ6*01 | 1730 | gnl|Fabrus|V2-6_IGLJ4*01 | 1122 |
| 4323 VH3-23_IGHD3-3*01 > 2_IGHJ6*01 | 1731 | gnl|Fabrus|V2-6_IGLJ4*01 | 1122 |
| 4324 VH3-23_IGHD3-3*01 > 3_IGHJ6*01 | 1732 | gnl|Fabrus|V2-6_IGLJ4*01 | 1122 |
| 4325 VH3-23_IGHD3-9*01 > 2_IGHJ6*01 | 1733 | gnl|Fabrus|V2-6_IGLJ4*01 | 1122 |
| 4326 VH3-23_IGHD3-10*01 > 2_IGHJ6*01 | 1734 | gnl|Fabrus|V2-6_IGLJ4*01 | 1122 |
| 4327 VH3-23_IGHD3-10*01 > 3_IGHJ6*01 | 1735 | gnl|Fabrus|V2-6_IGLJ4*01 | 1122 |
| 4328 VH3-23_IGHD3-16*01 > 2_IGHJ6*01 | 1736 | gnl|Fabrus|V2-6_IGLJ4*01 | 1122 |
| 4329 VH3-23_IGHD3-16*01 > 3_IGHJ6*01 | 1737 | gnl|Fabrus|V2-6_IGLJ4*01 | 1122 |
| 4330 VH3-23_IGHD3-22*01 > 2_IGHJ6*01 | 1738 | gnl|Fabrus|V2-6_IGLJ4*01 | 1122 |
| 4331 VH3-23_IGHD3-22*01 > 3_IGHJ6*01 | 1739 | gnl|Fabrus|V2-6_IGLJ4*01 | 1122 |
| 4332 VH3-23_IGHD4-4*01 (1) > 2_IGHJ6*01 | 1740 | gnl|Fabrus|V2-6_IGLJ4*01 | 1122 |
| 4333 VH3-23_IGHD4-4*01 (1) > 3_IGHJ6*01 | 1741 | gnl|Fabrus|V2-6_IGLJ4*01 | 1122 |
| 4334 VH3-23_IGHD4-11*01 (1) > 2_IGHJ6*01 | 1742 | gnl|Fabrus|V2-6_IGLJ4*01 | 1122 |
| 4335 VH3-23_IGHD4-11*01 (1) > 3_IGHJ6*01 | 1743 | gnl|Fabrus|V2-6_IGLJ4*01 | 1122 |
| 4336 VH3-23_IGHD4-17*01 > 2_IGHJ6*01 | 1744 | gnl|Fabrus|V2-6_IGLJ4*01 | 1122 |
| 4337 VH3-23_IGHD4-17*01 > 3_IGHJ6*01 | 1745 | gnl|Fabrus|V2-6_IGLJ4*01 | 1122 |
| 4338 VH3-23_IGHD4-23*01 > 2_IGHJ6*01 | 1746 | gnl|Fabrus|V2-6_IGLJ4*01 | 1122 |
| 4339 VH3-23_IGHD4-23*01 > 3_IGHJ6*01 | 1747 | gnl|Fabrus|V2-6_IGLJ4*01 | 1122 |
| 4340 VH3-23_IGHD5-5*01 (2) > 1_IGHJ6*01 | 1748 | gnl|Fabrus|V2-6_IGLJ4*01 | 1122 |
| 4341 VH3-23_IGHD5-5*01 (2) > 2_IGHJ6*01 | 1749 | gnl|Fabrus|V2-6_IGLJ4*01 | 1122 |
| 4342 VH3-23_IGHD5-5*01 (2) > 3_IGHJ6*01 | 1750 | gnl|Fabrus|V2-6_IGLJ4*01 | 1122 |
| 4343 VH3-23_IGHD5-12*01 > 1_IGHJ6*01 | 1751 | gnl|Fabrus|V2-6_IGLJ4*01 | 1122 |
| 4344 VH3-23_IGHD5-12*01 > 3_IGHJ6*01 | 1752 | gnl|Fabrus|V2-6_IGLJ4*01 | 1122 |
| 4345 VH3-23_IGHD5-18*01 (2) > 1_IGHJ6*01 | 1753 | gnl|Fabrus|V2-6_IGLJ4*01 | 1122 |
| 4346 VH3-23_IGHD5-18*01 (2) > 2_IGHJ6*01 | 1754 | gnl|Fabrus|V2-6_IGLJ4*01 | 1122 |
| 4347 VH3-23_IGHD5-18*01 (2) > 3_IGHJ6*01 | 1755 | gnl|Fabrus|V2-6_IGLJ4*01 | 1122 |
| 4348 VH3-23_IGHD5-24*01 > 1_IGHJ6*01 | 1756 | gnl|Fabrus|V2-6_IGLJ4*01 | 1122 |
| 4349 VH3-23_IGHD5-24*01 > 3_IGHJ6*01 | 1757 | gnl|Fabrus|V2-6_IGLJ4*01 | 1122 |
| 4350 VH3-23_IGHD6-6*01 > 1_IGHJ6*01 | 1758 | gnl|Fabrus|V2-6_IGLJ4*01 | 1122 |
| 4351 VH3-23_IGHD1-1*01 > 1'_IGHJ6*01 | 1768 | gnl|Fabrus|V2-6_IGLJ4*01 | 1122 |
| 4352 VH3-23_IGHD1-1*01 > 2'_IGHJ6*01 | 1769 | gnl|Fabrus|V2-6_IGLJ4*01 | 1122 |
| 4353 VH3-23_IGHD1-1*01 > 3'_IGHJ6*01 | 1770 | gnl|Fabrus|V2-6_IGLJ4*01 | 1122 |
| 4354 VH3-23_IGHD1-7*01 > 1'_IGHJ6*01 | 1771 | gnl|Fabrus|V2-6_IGLJ4*01 | 1122 |
| 4355 VH3-23_IGHD1-7*01 > 3'_IGHJ6*01 | 1772 | gnl|Fabrus|V2-6_IGLJ4*01 | 1122 |
| 4356 VH3-23_IGHD1-14*01 > 1'_IGHJ6*01 | 1773 | gnl|Fabrus|V2-6_IGLJ4*01 | 1122 |
| 4357 VH3-23_IGHD1-14*01 > 2'_IGHJ6*01 | 1774 | gnl|Fabrus|V2-6_IGLJ4*01 | 1122 |
| 4358 VH3-23_IGHD1-14*01 > 3'_IGHJ6*01 | 1775 | gnl|Fabrus|V2-6_IGLJ4*01 | 1122 |
| 4359 VH3-23_IGHD1-20*01 > 1'_IGHJ6*01 | 1776 | gnl|Fabrus|V2-6_IGLJ4*01 | 1122 |
| 4360 VH3-23_IGHD1-20*01 > 2'_IGHJ6*01 | 1777 | gnl|Fabrus|V2-6_IGLJ4*01 | 1122 |
| 4361 VH3-23_IGHD1-20*01 > 3'_IGHJ6*01 | 1778 | gnl|Fabrus|V2-6_IGLJ4*01 | 1122 |
| 4362 VH3-23_IGHD1-26*01 > 1'_IGHJ6*01 | 1779 | gnl|Fabrus|V2-6_IGLJ4*01 | 1122 |
| 4363 VH3-23_IGHD1-26*01 > 1_IGHJ6*01_B | 1780 | gnl|Fabrus|V2-6_IGLJ4*01 | 1122 |
| 4364 VH3-23_IGHD2-2*01 > 2_IGHJ6*01_B | 1781 | gnl|Fabrus|V2-6_IGLJ4*01 | 1122 |
| 4365 VH3-23_IGHD2-2*01 > 3'_IGHJ6*01 | 1782 | gnl|Fabrus|V2-6_IGLJ4*01 | 1122 |
| 4366 VH3-23_IGHD2-8*01 > 1'_IGHJ6*01 | 1783 | gnl|Fabrus|V2-6_IGLJ4*01 | 1122 |
| 4367 VH3-23_IGHD2-15*01 > 1'_IGHJ6*01 | 1784 | gnl|Fabrus|V2-6_IGLJ4*01 | 1122 |
| 4368 VH3-23_IGHD2-15*01 > 3'_IGHJ6*01 | 1785 | gnl|Fabrus|V2-6_IGLJ4*01 | 1122 |
| 4369 VH3-23_IGHD2-21*01 > 1'_IGHJ6*01 | 1786 | gnl|Fabrus|V2-6_IGLJ4*01 | 1122 |
| 4370 VH3-23_IGHD2-21*01 > 3'_IGHJ6*01 | 1787 | gnl|Fabrus|V2-6_IGLJ4*01 | 1122 |
| 4371 VH3-23_IGHD3-3*01 > 1'_IGHJ6*01 | 1788 | gnl|Fabrus|V2-6_IGLJ4*01 | 1122 |
| 4372 VH3-23_IGHD3-3*01 > 3'_IGHJ6*01 | 1789 | gnl|Fabrus|V2-6_IGLJ4*01 | 1122 |
| 4373 VH3-23_IGHD3-9*01 > 1'_IGHJ6*01 | 1790 | gnl|Fabrus|V2-6_IGLJ4*01 | 1122 |
| 4374 VH3-23_IGHD3-9*01 > 3'_IGHJ6*01 | 1791 | gnl|Fabrus|V2-6_IGLJ4*01 | 1122 |
| 4375 VH3-23_IGHD3-10*01 > 1'_IGHJ6*01 | 1792 | gnl|Fabrus|V2-6_IGLJ4*01 | 1122 |
| 4376 VH3-23_IGHD3-10*01 > 3'_IGHJ6*01 | 1793 | gnl|Fabrus|V2-6_IGLJ4*01 | 1122 |
| 4377 VH3-23_IGHD3-16*01 > 1'_IGHJ6*01 | 1794 | gnl|Fabrus|V2-6_IGLJ4*01 | 1122 |
| 4378 VH3-23_IGHD3-16*01 > 3'_IGHJ6*01 | 1795 | gnl|Fabrus|V2-6_IGLJ4*01 | 1122 |
| 4379 VH3-23_IGHD3-22*01 > 1'_IGHJ6*01 | 1796 | gnl|Fabrus|V2-6_IGLJ4*01 | 1122 |
| 4380 VH3-23_IGHD4-4*01 (1) > 1'_IGHJ6*01 | 1797 | gnl|Fabrus|V2-6_IGLJ4*01 | 1122 |
| 4381 VH3-23_IGHD4-4*01 (1) > 3'_IGHJ6*01 | 1798 | gnl|Fabrus|V2-6_IGLJ4*01 | 1122 |
| 4382 VH3-23_IGHD4-11*01 (1) > 1'_IGHJ6*01 | 1799 | gnl|Fabrus|V2-6_IGLJ4*01 | 1122 |
| 4383 VH3-23_IGHD4-11*01 (1) > 3'_IGHJ6*01 | 1800 | gnl|Fabrus|V2-6_IGLJ4*01 | 1122 |

TABLE 4-continued

Exemplary Paired Nucleic Acid Library

| HEAVY CHAIN | SEQ ID NO | LIGHT CHAIN | SEQ ID NO |
|---|---|---|---|
| 4384 VH3-23_IGHD4-17*01 > 1'_IGHJ6*01 | 1801 | gnl\|Fabrus\|V2-6_IGLJ4*01 | 1122 |
| 4385 VH3-23_IGHD4-17*01 > 3'_IGHJ6*01 | 1802 | gnl\|Fabrus\|V2-6_IGLJ4*01 | 1122 |
| 4386 VH3-23_IGHD4-23*01 > 1'_IGHJ6*01 | 1803 | gnl\|Fabrus\|V2-6_IGLJ4*01 | 1122 |
| 4387 VH3-23_IGHD4-23*01 > 3'_IGHJ6*01 | 1804 | gnl\|Fabrus\|V2-6_IGLJ4*01 | 1122 |
| 4388 VH3-23_IGHD5-5*01 (2) > 1'_IGHJ6*01 | 1805 | gnl\|Fabrus\|V2-6_IGLJ4*01 | 1122 |
| 4389 VH3-23_IGHD5-5*01 (2) > 3'_IGHJ6*01 | 1806 | gnl\|Fabrus\|V2-6_IGLJ4*01 | 1122 |
| 4390 VH3-23_IGHD5-12*01 > 1'_IGHJ6*01 | 1807 | gnl\|Fabrus\|V2-6_IGLJ4*01 | 1122 |
| 4391 VH3-23_IGHD5-12*01 > 3'_IGHJ6*01 | 1808 | gnl\|Fabrus\|V2-6_IGLJ4*01 | 1122 |
| 4392 VH3-23_IGHD5-18*01 (2) > 1'_IGHJ6*01 | 1809 | gnl\|Fabrus\|V2-6_IGLJ4*01 | 1122 |
| 4393 VH3-23_IGHD5-18*01 (2) > 3'_IGHJ6*01 | 1810 | gnl\|Fabrus\|V2-6_IGLJ4*01 | 1122 |
| 4394 VH3-23_IGHD5-24*01 > 1'_IGHJ6*01 | 1811 | gnl\|Fabrus\|V2-6_IGLJ4*01 | 1122 |
| 4395 VH3-23_IGHD5-24*01 > 3'_IGHJ6*01 | 1812 | gnl\|Fabrus\|V2-6_IGLJ4*01 | 1122 |
| 4396 VH3-23_IGHD6-6*01 > 1'_IGHJ6*01 | 1813 | gnl\|Fabrus\|V2-6_IGLJ4*01 | 1122 |
| 4397 VH3-23_IGHD6-6*01 > 2'_IGHJ6*01 | 1814 | gnl\|Fabrus\|V2-6_IGLJ4*01 | 1122 |
| 4398 VH3-23_IGHD6-6*01 > 3'_IGHJ6*01 | 1815 | gnl\|Fabrus\|V2-6_IGLJ4*01 | 1122 |
| 4399 VH3-23_IGHD1-1*01 > 1_IGHJ6*01 | 1711 | gnl\|Fabrus\|V2-7_IGLJ2*01 | 1123 |
| 4400 VH3-23_IGHD1-1*01 > 2_IGHJ6*01 | 1712 | gnl\|Fabrus\|V2-7_IGLJ2*01 | 1123 |
| 4401 VH3-23_IGHD1-1*01 > 3_IGHJ6*01 | 1713 | gnl\|Fabrus\|V2-7_IGLJ2*01 | 1123 |
| 4402 VH3-23_IGHD1-7*01 > 1_IGHJ6*01 | 1714 | gnl\|Fabrus\|V2-7_IGLJ2*01 | 1123 |
| 4403 VH3-23_IGHD1-7*01 > 3_IGHJ6*01 | 1715 | gnl\|Fabrus\|V2-7_IGLJ2*01 | 1123 |
| 4404 VH3-23_IGHD1-14*01 > 1_IGHJ6*01 | 1716 | gnl\|Fabrus\|V2-7_IGLJ2*01 | 1123 |
| 4405 VH3-23_IGHD1-14*01 > 3_IGHJ6*01 | 1717 | gnl\|Fabrus\|V2-7_IGLJ2*01 | 1123 |
| 4406 VH3-23_IGHD1-20*01 > 1_IGHJ6*01 | 1718 | gnl\|Fabrus\|V2-7_IGLJ2*01 | 1123 |
| 4407 VH3-23_IGHD1-20*01 > 3_IGHJ6*01 | 1719 | gnl\|Fabrus\|V2-7_IGLJ2*01 | 1123 |
| 4408 VH3-23_IGHD1-26*01 > 1_IGHJ6*01 | 1720 | gnl\|Fabrus\|V2-7_IGLJ2*01 | 1123 |
| 4409 VH3-23_IGHD1-26*01 > 3_IGHJ6*01 | 1721 | gnl\|Fabrus\|V2-7_IGLJ2*01 | 1123 |
| 4410 VH3-23_IGHD2-2*01 > 2_IGHJ6*01 | 1722 | gnl\|Fabrus\|V2-7_IGLJ2*01 | 1123 |
| 4411 VH3-23_IGHD2-2*01 > 3_IGHJ6*01 | 1723 | gnl\|Fabrus\|V2-7_IGLJ2*01 | 1123 |
| 4412 VH3-23_IGHD2-8*01 > 2_IGHJ6*01 | 1724 | gnl\|Fabrus\|V2-7_IGLJ2*01 | 1123 |
| 4413 VH3-23_IGHD2-8*01 > 3_IGHJ6*01 | 1725 | gnl\|Fabrus\|V2-7_IGLJ2*01 | 1123 |
| 4414 VH3-23_IGHD2-15*01 > 2_IGHJ6*01 | 1726 | gnl\|Fabrus\|V2-7_IGLJ2*01 | 1123 |
| 4415 VH3-23_IGHD2-15*01 > 3_IGHJ6*01 | 1727 | gnl\|Fabrus\|V2-7_IGLJ2*01 | 1123 |
| 4416 VH3-23_IGHD2-21*01 > 2_IGHJ6*01 | 1728 | gnl\|Fabrus\|V2-7_IGLJ2*01 | 1123 |
| 4417 VH3-23_IGHD2-21*01 > 3_IGHJ6*01 | 1729 | gnl\|Fabrus\|V2-7_IGLJ2*01 | 1123 |
| 4418 VH3-23_IGHD3-3*01 > 1_IGHJ6*01 | 1730 | gnl\|Fabrus\|V2-7_IGLJ2*01 | 1123 |
| 4419 VH3-23_IGHD3-3*01 > 2_IGHJ6*01 | 1731 | gnl\|Fabrus\|V2-7_IGLJ2*01 | 1123 |
| 4420 VH3-23_IGHD3-3*01 > 3_IGHJ6*01 | 1732 | gnl\|Fabrus\|V2-7_IGLJ2*01 | 1123 |
| 4421 VH3-23_IGHD3-9*01 > 2_IGHJ6*01 | 1733 | gnl\|Fabrus\|V2-7_IGLJ2*01 | 1123 |
| 4422 VH3-23_IGHD3-10*01 > 2_IGHJ6*01 | 1734 | gnl\|Fabrus\|V2-7_IGLJ2*01 | 1123 |
| 4423 VH3-23_IGHD3-10*01 > 3_IGHJ6*01 | 1735 | gnl\|Fabrus\|V2-7_IGLJ2*01 | 1123 |
| 4424 VH3-23_IGHD3-16*01 > 2_IGHJ6*01 | 1736 | gnl\|Fabrus\|V2-7_IGLJ2*01 | 1123 |
| 4425 VH3-23_IGHD3-16*01 > 3_IGHJ6*01 | 1737 | gnl\|Fabrus\|V2-7_IGLJ2*01 | 1123 |
| 4426 VH3-23_IGHD3-22*01 > 2_IGHJ6*01 | 1738 | gnl\|Fabrus\|V2-7_IGLJ2*01 | 1123 |
| 4427 VH3-23_IGHD3-22*01 > 3_IGHJ6*01 | 1739 | gnl\|Fabrus\|V2-7_IGLJ2*01 | 1123 |
| 4428 VH3-23_IGHD4-4*01 (1) > 2_IGHJ6*01 | 1740 | gnl\|Fabrus\|V2-7_IGLJ2*01 | 1123 |
| 4429 VH3-23_IGHD4-4*01 (1) > 3_IGHJ6*01 | 1741 | gnl\|Fabrus\|V2-7_IGLJ2*01 | 1123 |
| 4430 VH3-23_IGHD4-11*01 (1) > 2_IGHJ6*01 | 1742 | gnl\|Fabrus\|V2-7_IGLJ2*01 | 1123 |
| 4431 VH3-23_IGHD4-11*01 (1) > 3_IGHJ6*01 | 1743 | gnl\|Fabrus\|V2-7_IGLJ2*01 | 1123 |
| 4432 VH3-23_IGHD4-17*01 > 2_IGHJ6*01 | 1744 | gnl\|Fabrus\|V2-7_IGLJ2*01 | 1123 |
| 4433 VH3-23_IGHD4-17*01 > 3_IGHJ6*01 | 1745 | gnl\|Fabrus\|V2-7_IGLJ2*01 | 1123 |
| 4434 VH3-23_IGHD4-23*01 > 2_IGHJ6*01 | 1746 | gnl\|Fabrus\|V2-7_IGLJ2*01 | 1123 |
| 4435 VH3-23_IGHD4-23*01 > 3_IGHJ6*01 | 1747 | gnl\|Fabrus\|V2-7_IGLJ2*01 | 1123 |
| 4436 VH3-23_IGHD5-5*01 (2) > 1_IGHJ6*01 | 1748 | gnl\|Fabrus\|V2-7_IGLJ2*01 | 1123 |
| 4437 VH3-23_IGHD5-5*01 (2) > 2_IGHJ6*01 | 1749 | gnl\|Fabrus\|V2-7_IGLJ2*01 | 1123 |
| 4438 VH3-23_IGHD5-5*01 (2) > 3_IGHJ6*01 | 1750 | gnl\|Fabrus\|V2-7_IGLJ2*01 | 1123 |
| 4439 VH3-23_IGHD5-12*01 > 1_IGHJ6*01 | 1751 | gnl\|Fabrus\|V2-7_IGLJ2*01 | 1123 |
| 4440 VH3-23_IGHD5-12*01 > 3_IGHJ6*01 | 1752 | gnl\|Fabrus\|V2-7_IGLJ2*01 | 1123 |
| 4441 VH3-23_IGHD5-18*01 (2) > 1_IGHJ6*01 | 1753 | gnl\|Fabrus\|V2-7_IGLJ2*01 | 1123 |
| 4442 VH3-23_IGHD5-18*01 (2) > 2_IGHJ6*01 | 1754 | gnl\|Fabrus\|V2-7_IGLJ2*01 | 1123 |
| 4443 VH3-23_IGHD5-18*01 (2) > 3_IGHJ6*01 | 1755 | gnl\|Fabrus\|V2-7_IGLJ2*01 | 1123 |
| 4444 VH3-23_IGHD5-24*01 > 1_IGHJ6*01 | 1756 | gnl\|Fabrus\|V2-7_IGLJ2*01 | 1123 |
| 4445 VH3-23_IGHD5-24*01 > 3_IGHJ6*01 | 1757 | gnl\|Fabrus\|V2-7_IGLJ2*01 | 1123 |
| 4446 VH3-23_IGHD6-6*01 > 1_IGHJ6*01 | 1758 | gnl\|Fabrus\|V2-7_IGLJ2*01 | 1123 |
| 4447 VH3-23_IGHD1-1*01 > 1'_IGHJ6*01 | 1768 | gnl\|Fabrus\|V2-7_IGLJ2*01 | 1123 |
| 4448 VH3-23_IGHD1-1*01 > 2'_IGHJ6*01 | 1769 | gnl\|Fabrus\|V2-7_IGLJ2*01 | 1123 |
| 4449 VH3-23_IGHD1-1*01 > 3'_IGHJ6*01 | 1770 | gnl\|Fabrus\|V2-7_IGLJ2*01 | 1123 |
| 4450 VH3-23_IGHD1-7*01 > 1'_IGHJ6*01 | 1771 | gnl\|Fabrus\|V2-7_IGLJ2*01 | 1123 |
| 4451 VH3-23_IGHD1-7*01 > 3'_IGHJ6*01 | 1772 | gnl\|Fabrus\|V2-7_IGLJ2*01 | 1123 |
| 4452 VH3-23_IGHD1-14*01 > 1'_IGHJ6*01 | 1773 | gnl\|Fabrus\|V2-7_IGLJ2*01 | 1123 |
| 4453 VH3-23_IGHD1-14*01 > 2'_IGHJ6*01 | 1774 | gnl\|Fabrus\|V2-7_IGLJ2*01 | 1123 |
| 4454 VH3-23_IGHD1-14*01 > 3'_IGHJ6*01 | 1775 | gnl\|Fabrus\|V2-7_IGLJ2*01 | 1123 |
| 4455 VH3-23_IGHD1-20*01 > 1'_IGHJ6*01 | 1776 | gnl\|Fabrus\|V2-7_IGLJ2*01 | 1123 |
| 4456 VH3-23_IGHD1-20*01 > 2'_IGHJ6*01 | 1777 | gnl\|Fabrus\|V2-7_IGLJ2*01 | 1123 |
| 4457 VH3-23_IGHD1-20*01 > 3'_IGHJ6*01 | 1778 | gnl\|Fabrus\|V2-7_IGLJ2*01 | 1123 |

TABLE 4-continued

Exemplary Paired Nucleic Acid Library

| HEAVY CHAIN | SEQ ID NO | LIGHT CHAIN | SEQ ID NO |
|---|---|---|---|
| 4458 VH3-23_IGHD1-26*01 > 1'_IGHJ6*01 | 1779 | gnl\|Fabrus\|V2-7_IGLJ2*01 | 1123 |
| 4459 VH3-23_IGHD1-26*01 > 1_IGHJ6*01_B | 1780 | gnl\|Fabrus\|V2-7_IGLJ2*01 | 1123 |
| 4460 VH3-23_IGHD2-2*01 > 2_IGHJ6*01_B | 1781 | gnl\|Fabrus\|V2-7_IGLJ2*01 | 1123 |
| 4461 VH3-23_IGHD2-2*01 > 3'_IGHJ6*01 | 1782 | gnl\|Fabrus\|V2-7_IGLJ2*01 | 1123 |
| 4462 VH3-23_IGHD2-8*01 > 1'_IGHJ6*01 | 1783 | gnl\|Fabrus\|V2-7_IGLJ2*01 | 1123 |
| 4463 VH3-23_IGHD2-15*01 > 1'_IGHJ6*01 | 1784 | gnl\|Fabrus\|V2-7_IGLJ2*01 | 1123 |
| 4464 VH3-23_IGHD2-15*01 > 3'_IGHJ6*01 | 1785 | gnl\|Fabrus\|V2-7_IGLJ2*01 | 1123 |
| 4465 VH3-23_IGHD2-21*01 > 1'_IGHJ6*01 | 1786 | gnl\|Fabrus\|V2-7_IGLJ2*01 | 1123 |
| 4466 VH3-23_IGHD2-21*01 > 3'_IGHJ6*01 | 1787 | gnl\|Fabrus\|V2-7_IGLJ2*01 | 1123 |
| 4467 VH3-23_IGHD3-3*01 > 1'_IGHJ6*01 | 1788 | gnl\|Fabrus\|V2-7_IGLJ2*01 | 1123 |
| 4468 VH3-23_IGHD3-3*01 > 3'_IGHJ6*01 | 1789 | gnl\|Fabrus\|V2-7_IGLJ2*01 | 1123 |
| 4469 VH3-23_IGHD3-9*01 > 1'_IGHJ6*01 | 1790 | gnl\|Fabrus\|V2-7_IGLJ2*01 | 1123 |
| 4470 VH3-23_IGHD3-9*01 > 3'_IGHJ6*01 | 1791 | gnl\|Fabrus\|V2-7_IGLJ2*01 | 1123 |
| 4471 VH3-23_IGHD3-10*01 > 1'_IGHJ6*01 | 1792 | gnl\|Fabrus\|V2-7_IGLJ2*01 | 1123 |
| 4472 VH3-23_IGHD3-10*01 > 3'_IGHJ6*01 | 1793 | gnl\|Fabrus\|V2-7_IGLJ2*01 | 1123 |
| 4473 VH3-23_IGHD3-16*01 > 1'_IGHJ6*01 | 1794 | gnl\|Fabrus\|V2-7_IGLJ2*01 | 1123 |
| 4474 VH3-23_IGHD3-16*01 > 3'_IGHJ6*01 | 1795 | gnl\|Fabrus\|V2-7_IGLJ2*01 | 1123 |
| 4475 VH3-23_IGHD3-22*01 > 1'_IGHJ6*01 | 1796 | gnl\|Fabrus\|V2-7_IGLJ2*01 | 1123 |
| 4476 VH3-23_IGHD4-4*01 (1) > 1'_IGHJ6*01 | 1797 | gnl\|Fabrus\|V2-7_IGLJ2*01 | 1123 |
| 4477 VH3-23_IGHD4-4*01 (1) > 3'_IGHJ6*01 | 1798 | gnl\|Fabrus\|V2-7_IGLJ2*01 | 1123 |
| 4478 VH3-23_IGHD4-11*01 (1) > 1'_IGHJ6*01 | 1799 | gnl\|Fabrus\|V2-7_IGLJ2*01 | 1123 |
| 4479 VH3-23_IGHD4-11*01 (1) > 3'_IGHJ6*01 | 1800 | gnl\|Fabrus\|V2-7_IGLJ2*01 | 1123 |
| 4480 VH3-23_IGHD4-17*01 > 1'_IGHJ6*01 | 1801 | gnl\|Fabrus\|V2-7_IGLJ2*01 | 1123 |
| 4481 VH3-23_IGHD4-17*01 > 3'_IGHJ6*01 | 1802 | gnl\|Fabrus\|V2-7_IGLJ2*01 | 1123 |
| 4482 VH3-23_IGHD4-23*01 > 1'_IGHJ6*01 | 1803 | gnl\|Fabrus\|V2-7_IGLJ2*01 | 1123 |
| 4483 VH3-23_IGHD4-23*01 > 3'_IGHJ6*01 | 1804 | gnl\|Fabrus\|V2-7_IGLJ2*01 | 1123 |
| 4484 VH3-23_IGHD5-5*01 (2) > 1'_IGHJ6*01 | 1805 | gnl\|Fabrus\|V2-7_IGLJ2*01 | 1123 |
| 4485 VH3-23_IGHD5-5*01 (2) > 3'_IGHJ6*01 | 1806 | gnl\|Fabrus\|V2-7_IGLJ2*01 | 1123 |
| 4486 VH3-23_IGHD5-12*01 > 1'_IGHJ6*01 | 1807 | gnl\|Fabrus\|V2-7_IGLJ2*01 | 1123 |
| 4487 VH3-23_IGHD5-12*01 > 3'_IGHJ6*01 | 1808 | gnl\|Fabrus\|V2-7_IGLJ2*01 | 1123 |
| 4488 VH3-23_IGHD5-18*01 (2) > 1'_IGHJ6*01 | 1809 | gnl\|Fabrus\|V2-7_IGLJ2*01 | 1123 |
| 4489 VH3-23_IGHD5-18*01 (2) > 3'_IGHJ6*01 | 1810 | gnl\|Fabrus\|V2-7_IGLJ2*01 | 1123 |
| 4490 VH3-23_IGHD5-24*01 > 1'_IGHJ6*01 | 1811 | gnl\|Fabrus\|V2-7_IGLJ2*01 | 1123 |
| 4491 VH3-23_IGHD5-24*01 > 3'_IGHJ6*01 | 1812 | gnl\|Fabrus\|V2-7_IGLJ2*01 | 1123 |
| 4492 VH3-23_IGHD6-6*01 > 1'_IGHJ6*01 | 1813 | gnl\|Fabrus\|V2-7_IGLJ2*01 | 1123 |
| 4493 VH3-23_IGHD6-6*01 > 2'_IGHJ6*01 | 1814 | gnl\|Fabrus\|V2-7_IGLJ2*01 | 1123 |
| 4494 VH3-23_IGHD6-6*01 > 3'_IGHJ6*01 | 1815 | gnl\|Fabrus\|V2-7_IGLJ2*01 | 1123 |

Typically, the addressable combinatorial germline libraries are spatially arrayed in a multiwell plate, such as a 96-well plate, wherein each well of the plate corresponds to one antibody that is different from the antibodies in all the other wells. The antibodies can be immobilized to the surface of the wells of the plate or can be present in solution. Alternatively, the antibodies are attached to a solid support, such as for example, a filter, chip, slide, bead or cellulose. The antibodies can also be identifiably labeled, such as for example, with a colored, chromogenic, luminescent, chemical, fluorescent or electronic label. The combinatorial addressable germline antibody libraries can be screened for binding or activity against a target protein to identify antibodies or portions thereof that bind to a target protein and/or modulate an activity of a target protein. By virtue of the fact that these libaries are arrayed, the identity of each individual member in the collection is known during screening thereby allowing facile identification of a "Hit" antibody. Screening for binding or a functional activity can be by any method known to one of skill in the art, for example, any described in Section E.1.

For example, as described in the Examples, an addressable antibody library is exemplified to screen for "Hits" against a target antigen using an MSD electrochemiluminescence binding assay or by ELISA. Since the library was addressable, the sequence of the identified "Hit" was immediately known. A similar assay is exemplified to identify a related antibody as discussed further below.

b. Identification of a Related Antibody

In the method provided herein, comparison to a related antibody that has reduced or less activity for the target antigen than the first antibody provides information of SAR that can be used for affinity maturation herein. In the method, residues to mutagenize in the antibody to be affinity matured are identified by comparison of the amino acid sequence of the variable heavy or light chain of the first antibody (e.g."Hit") with the corresponding amino acid sequence of the variable heavy or light chain of a related antibody. For purposes of practice of the method herein, a related antibody has sequence similarity or identity to the "Hit" antibody across the entire sequence of the antibody (heavy and light chain), but is not itself identical in sequence to the "Hit" antibody. In addition, the related antibody exhibits less activity (e.g. binding or binding affinity) for the target antigen than the first antibody.

In the method herein, once a first antibody is chosen for affinity maturation herein as set forth above, one or more related antibodies are selected. It is not necessary that the first antibody and related antibodies are identified from the same library or even using the same screening method. All that is necessary is that the related antibody has less activity to a target antigen than the first antibody and that the related antibody exhibits sequence similarity to the antibody that is being affinity matured. For convenience, a related antibody is typically identified using the same screening method and assay system used for identification of the first antibody.

Hence, any of the methods of generating an antibody, including any of the antibody libraries, described in Section C.1 above can be used for identification of a related antibody. Exemplary of an antibody library is an addressable combinatorial antibody library described above and herein in the Examples. As previously mentioned, the addressable combinatorial antibody library has the benefit of immediate knowledge of the structure-activity relationship of all members of the library for binding to a target antigen. Hence, like a "Hit" antibody, the sequence and activity of a related antibody is immediately known. Accordingly, assessment of sequence similarity between a "Hit" and related antibody can be determined almost instantaneously upon completion of a screening assay for a target antigen.

Generally, the related antibody is an antibody that exhibits 80% of less of the activity of the first antibody, generally 5% to 80% of the activity, and in particular 5% to 50% of the activity, such as 80%, 70%, 60%, 50%, 40%, 30%, 20%, 10%, 5% or less the activity towards the target antigen compared to the first antibody. For example, the related antibody can be an antibody that does not bind or that shows negligible binding to the target antigen for which the "Hit" antibody binds (e.g. a level of binding that is the same or similar to binding of a negative control used in the assay). Thus, a related antibody can be initially identified because it does not specifically bind to the target antigen for which the chosen first antibody specifically binds. For example, a related antibody can exhibit a binding affinity that is $10^{-4}$ M or higher, for example, $10^{-4}$ M, $10^{-3}$ M, $10^{-2}$ M, or higher. In comparing an activity (e.g. binding and/or binding affinity) of first antibody to a related antibody, the same target antigen is used and activity is assessed in the same or similar assay. In addition, corresponding forms of the antibodies are compared such that the structure of the antibody also is the same (e.g. full-length antibody or fragment thereof such as a Fab).

A related antibody that is chosen for practice of the method is related to the first antibody because it exhibits sequence similarity or identity to a first antibody across its entire sequence (heavy and light chain) or across its variable heavy or variable light chain. For example, the amino acid sequence of the variable heavy chain and/or variable light chain of the related antibody is at least 50% identical in amino acid sequence to the first antibody, generally at least 75% identical in sequence, for example it is or is about 50%, 60%, 65%, 70%, 75%, 80%, 85%, 90%, 91%, 92%, 93%, 94%, 95%, 96%, 97%, 98%, 99% or 100% identical in amino acid sequence to the first antibody, typically at least at or about 75%, 80%, 85%, 90%, 91%, 92%, 93%, 94%, 95% similar in sequence. The related antibody is not identical to the first antibody in both the variable heavy and light chain, but can be identical to the first antibody in one of the variable heavy or light chains and exhibit less than 100% sequence similarity in the other chain. Thus, it is understood that for practice of the method, the variable portion of the related antibody used in the method is less than 100% identical to the identified "Hit" antibody. For example, in many instances, a related antibody might exhibit 100% sequence identity to the first antibody in the variable light chain sequence, but less than 100% sequence similarity to the first antibody in the variable heavy chain sequence, while still exhibiting a requisite sequence similarity. In that instance, only the variable heavy chain sequence of the related antibody is used in the practice of the method as described herein. Any method for determining sequence similarity known to one of skill in the art can be used as described elsewhere herein, including, but not limited to, manual methods or the use of available programs such as BLAST.

For example, a related antibody can contain a variable heavy chain that is identical to the variable heavy chain of the first antibody, and a variable light chain that exhibits sequence similarity to the first antibody. In other examples, neither the variable heavy or variable light chain of the related antibody are identical to the amino acid sequence of the first antibody, but both exhibit sequence similarity to the first antibody. Thus, in some instances, a related antibody used in the method of affinity maturing the variable heavy chain of the first antibody is different from a related antibody used in the method of affinity maturing the variable light chain of the first antibody. Accordingly, more than one related antibody can be selected for practice of the method herein. For example, as exemplified in the examples, three related antibodies are selected for affinity maturation of the variable light chain. In either case, a variable chain (heavy or light) of a related antibody that exhibits sequence similarity to the corresponding heavy or light chain of the first antibody is used in the method to identify a region or regions in the first antibody that differ and thus are responsible for the differing binding abilities of the "first antibody and related antibodies. Such region or regions are targeted for affinity maturation and mutagenesis in the method herein as described further below.

Generally, the variable heavy and/or light chain of a first antibody and a related antibody are derived from the same or related, such as from the same gene family, antibody variable region germline segments. For example, a related antibody is encoded by a sequence of nucleic acids that contains one or more variable heavy chain $V_H$, $D_H$ and/or $J_H$ germline segments or variable light chain $V_\kappa$ and $J_\kappa$ or $V_\lambda$, and $J_\lambda$, germline segments that is not identical to, but is of the same gene family, as contained in the nucleic acid sequence encoding the first antibody. Typically, a related antibody is encoded by a sequence of nucleic acids that contains identical germline segments to the nucleic acid sequence encoding the first antibody, except that 1, 2, 3, 4, or 5 of the germline segments are different or related. For example, a related antibody is encoded by a nucleic acid sequence encoding the VH or VL chain that contains the same variable heavy chain $V_H$, and $D_H$ germline segments, or the same variable light chain $V_\kappa$ or $V_\lambda$ germline segments, but different or related $J_H$, and $J_\kappa$ or $J_\lambda$ germline segments. As exemplified in the Examples, the variable heavy chain of a related antibody was chosen for practice of the method herein because it was encoded by a sequence of nucleic acids that contained identical variable heavy chain $V_H$ and $J_H$ germline segments (i.e., VH5-51 and IGHJ4*01) but had a different $D_H$ germline segment (i.e., IGHD5-51*01>3 versus IGHD6-25*01) compared to the sequence of nucleic acids encoding the variable heavy chain sequence of the chosen "Hit". The sequence of the variable heavy chain of the related antibody exhibits 98% sequence similarity to the first antibody. In another example, the variable heavy chain of a related antibody was chosen for practice of the method herein because it was encoded by a sequence of nucleic acids that contained identical $V_H$ germline segments (i.e., VH1-46), but different $J_H$ germline segments (i.e., IGHJ4*01 versus IGHJ1*01), and related $D_H$ germline segments (i.e., IGHD6-13*01 versus IGHD6-6*01, sharing the same gene family IGHD6) compared to the sequence of nucleic acids encoding the variable heavy chain sequence of the chosen first antibody. The sequence of the variable heavy chain of the related antibody exhibits 95% sequence similarity to the first antibody.

One of skill in the art knows and is familiar with germline segment sequences of antibodies, and can identify the germline segment sequences encoding an antibody heavy or light chain. Exemplary antibody germline sources include but are not limited to databases at the National Center for Biotechnology Information (NCBI), the international ImMunoGeneTics information System® (IMGT), the Kabat database and the Tomlinson's VBase database (Lefranc (2003) *Nucleic Acids Res.*, 31:307-310; Martin et al., Bioinformatics Tools for Antibody Engineering in Handbook of Therapeutic Antibodies, Wiley-VCH (2007), pp. 104-107). Germline segments also are known for non-humans. For example, an exemplary mouse germline databases is ABG database available at ibt.unam.mx/vir/v_mice.html. Germline segment sequences are known by various nomenclatures, including for example, IMGT gene names and definitions approved by the Human Genome Organization (HUGO) nomenclature committee, Lefranc, M.-P. *Exp Clin Immunogenet*, 18:100-116 (2001), Zachau, H. G. *Immunologist*, 4:49-54 (1996), Lefranc, M.-P. *Exp Clin Immunogenet*, 18:161-174 (2000), Kawasaki et al, Genome Res, 7:250-261 (1997), Lefranc, M.-P. *Exp Clin Immunogenet*, 18:242-254 (2001). Any desired naming convention can be used to identify antibody germline segments. One of skill in the art can identify a nucleic acid sequence using any desired naming convention. For example, for IMGT nomenclature, the first three letters indicate the locus (IGH, IGK or IGL), the fourth letter represents the gene (e.g., V for V-gene, D for D-gene, J for J-gene), the fifth position indicates the number of the subgroup, followed by a hyphen indicating the gene number classification. For alleles, the IMGT name is followed by an asterisk and a two figure number. U.S. Provisional Application Nos. 61/198,764 and 61/211,204 set forth exemplary human heavy chain and light chain (kappa and lambda) germline segment sequences.

c. Comparison of the Amino Acid Sequences of the First Antibody and Related Antibodies Once a first antibody is chosen and a related antibody or antibodies are identified that have a related variable heavy chain and/or variable light chain, sequence comparison of the antibodies is effected. Comparison of the amino acid sequence of the variable heavy chain and/or the variable light chain of the parent or first antibody and the related antibody permits identification of regions that differ between the first antibody and the related antibody. Such region or regions are targeted for affinity maturation and mutagenesis.

In the method, the amino acid sequence of the VH chain and/or the VL chain of the parent first antibody is aligned to the respective VH chain or VL chain of at least one related antibody to identify regions of the polypeptide that differ, or vary, between the first antibody and related antibodies. The amino acid sequences of the antibodies can be aligned by any method commonly known in the art. The methods include manual alignment, computer assisted sequence alignment, and combinations thereof. A number of algorithms (which are generally computer implemented) for performing sequence alignment are widely available, or can be produced by one of skill. These methods include, e.g., the local homology algorithm of Smith and Waterman (1981) *Adv. Appl. Math.* 2:482; the homology alignment algorithm of Needleman and Wunsch (1970) *J. Mol. Biol.* 48:443; the search for similarity method of Pearson and Lipman (1988) *Proc. Natl. Acad. Sci.* (*USA*) 85:2444; and/or by computerized implementations of these algorithms (e.g., GAP, BESTFIT, FASTA, and TFASTA in the Wisconsin Genetics Software Package Release 7.0, Genetics Computer Group, 575 Science Dr., Madison, Wis.).

For example, software for performing sequence identity (and sequence similarity) analysis using the BLAST algorithm is described in Altschul et al., (1990) *J. Mol. Biol.* 215:403-410. This software is publicly available, e.g., through the National Center for Biotechnology Information on the world wide web at ncbi.nlm.nih.gov. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP (BLAST Protein) program uses as defaults a wordlength (W) of 3, an expectation (E) of 10, and the BLOSUM62 scoring matrix (see, Henikoff and Henikoff (1989) *Proc. Natl. Acad. Sci. USA* 89:10915).

Additionally, the BLAST algorithm performs a statistical analysis of the similarity between two sequences (see, e.g., Karlin and Altschul (1993) *Proc. Nat'l. Acad. Sci. USA* 90:5873-5787). One measure of similarity provided by the BLAST algorithm is the smallest sum probability (P(N)), which provides an indication of the probability by which a match between two nucleotide or amino acid sequences occurs by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001.

An additional example of an algorithm that is suitable for multiple DNA, or amino acid, sequence alignments is the CLUSTALW program (Thompson, J. D. et al., (1994) *Nucl. Acids. Res.* 22: 4673-4680). CLUSTALW performs multiple pairwise comparisons between groups of sequences and assembles them into a multiple alignment based on homology. Gap open and Gap extension penalties can be, e.g., 10 and 0.05 respectively. For amino acid alignments, the BLOSUM algorithm can be used as a protein weight matrix. See, e.g., Henikoff and Henikoff (1992) *Proc. Natl. Acad. Sci. USA* 89: 10915-10919.

By aligning the amino acid sequences of the antibodies, one skilled in the art can identify regions that differ between the amino acid sequence of the first antibody and the related antibodies. A region that differs between the antibodies can occur along any portion of the VH chain and/or VL chain. Typically, a region that differs or varies occurs at a CDR or framework (FR) region, for example, CDR1, CDR2, CDR3, FR1, FR2, FR3 and/or FR4, and in particular in a CDR, for example CDR3. One of skill in the art knows and can identify the CDRs and FR based on Kabat or Chothia numbering (see e.g., Kabat, E. A. et al. (1991) *Sequences of Proteins of Immunological Interest*, Fifth Edition, U.S. Department of Health and Human Services, NIH Publication No. 91-3242, and Chothia, C. et al. (1987) *J. Mol. Biol.* 196:901-917). For example, based on Kabat numbering, CDR-L1 corresponds to residues L24-L34; CDR-L2 corresponds to residues L50-L56; CDR-L3 corresponds to residues L89-L97; CDR-H1 corresponds to residues H31-H35, 35a or 35b depending on the length; CDR-H2 corresponds to residues H50-H65; and CDR-H3 corresponds to residues H95-H102. For example, based on Kabat numbering, FR-L1 corresponds to residues L1-L23; FR-L2 corresponds to residues L35-L49; FR-L3 corresponds to residues L57-L88; FR-L4 corresponds to residues L98-L109; FR-H1 corresponds to residues H1-H30; FR-H2 corresponds to residues H36-H49; FR-H3 corresponds to residues H66-H94; and FR-H4 corresponds to residues H103-H113.

A region(s) that differs is identified as a target region because it contains at least one acid differences or variation at corresponding amino acid positions in the variable heavy chain and/or variable light chain amino acid sequence of a first antibody and a related antibody. A variant position includes an amino acid deletion, addition or substitution in the first antibody polypeptide as compared to the related antibody polypeptide. For purposes herein, an identified region contains one or more, typically two or more, for example, 2, 3, 4, 5, 6, 7, 8, 9, 10 or more variant amino acid positions in at least one region of a variable chain of the first antibody antibody compared to a related antibody. In some examples, more then one region, for example, 1, 2, 3, 4 or more regions can be identified that contain at least one variant amino acid positions between a first antibody and a related antibody. Any one or more of the regions can be targeted for affinity maturation by mutagenesis. Generally, a CDR is targeted for mutagenesis.

d. Mutagenesis of an Identified Region

In the method, mutagenesis is performed on target residues within the identified target region. For example, some or up to all amino acid residues of the selected target region in the heavy chain and/or light chain of the first antibody are mutated, for example, 1, 2, 3, 4, 5, 6, 7, 8, 9, 10, 11, 12, 13, 14, 15, 16, 17, 18, 19, 20, 21, 22, 23, 24, 25 or more amino acid residues. Each target amino acid residue selected for mutagenesis can be mutated to all 19 other amino acid residues, or to a restricted subset thereof.

In one example, all amino acid residues in the identified target region, e.g. CDR3, can be subject to mutagenesis. In another example, a subset of amino acid residues in the selected target region can be subject to mutagenesis. For example, only the amino acid residues at positions that differ between the first antibody and related antibody are subject to mutagenesis. In another example, only the amino acid residues at positions that are the same between the first antibody and a related antibody are subject to mutagenesis. In an additional example, scanning mutagenesis is optionally performed to identify residues that increase binding to the target antigen. In such examples, only those residues that are identified as "UP" mutants as discussed below are subject to further saturation mutagenesis.

For example, typically, a CDR can contain 3 to 25 amino acid residues. All or subset of the amino acids within a CDR can be targeted for mutagenesis, for example, 1, 2, 3, 4, 5, 6, 7, 8, 9, 10, 11, 12, 13, 14, 15, 16, 17, 18, 19, 20, 21, 22, 23, 24, or 25 amino acid residues can be targeted for mutagenesis. In some examples, all amino acids within a CDR are selected for mutagenesis. In other examples, only a subset of amino acids within a CDR are selected for mutagenesis. In some instances, only one amino acid residue within a CDR is selected for mutagenesis. In other instances, two or more amino acids are selected for mutagenesis.

The amino acid residues that are selected for further mutagenesis can be modified by any method known to one of skill in the art. The amino acid residues can be modified rationally or can be modified by random mutagenesis. This can be accomplished by modifying the encoding DNA. One of skill in the art is familiar with mutagenesis methods. Mutagenesis methods include, but are not limited to, site-mediated mutagenesis, PCR mutagenesis, cassette mutagenesis, site-directed mutagenesis, random point mutagenesis, mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient host strains, restriction-selection and restriction-purification, deletion mutagenesis, mutagenesis by total gene synthesis, double-strand break repair, and many others known to persons of skill. See, e.g., Arnold (1993) *Current Opinion in Biotechnology* 4:450-455; Bass et al., (1988) *Science* 242: 240-245; Botstein and Shortie (1985) *Science* 229:1193-1201; Carter et al., (1985) *Nucl. Acids Res.* 13: 4431-4443; Carter (1986) *Biochem. J.* 237:1-7; Carter (1987) *Methods in Enzymol.* 154: 382-403; Dale et al., (1996) *Methods Mol. Biol.* 57:369-374; Eghtedarzadeh and Henikoff (1986) *Nucl. Acids Res.* 14: 5115; Fritz et al., (1988) *Nucl. Acids Res.* 16: 6987-6999; Grundstrom et al., (1985) *Nucl. Acids Res.* 13: 3305-3316; Kunkel (1987) "The efficiency of oligonucleotide directed mutagenesis" in Nucleic Acids and Molecular Biology (Eckstein, F. and Lilley, D. M. J. eds., Springer Verlag, Berlin); Kunkel (1985) *Proc. Natl. Acad. Sci. USA* 82:488-492; Kunkel et al., (1987) *Methods in Enzymol.* 154, 367-382; Kramer et al., (1984) *Nucl. Acids Res.* 12: 9441-9456; Kramer and Fritz (1987) *Methods in Enzymol.* 154: 350-367; Kramer et al., (1984) *Cell* 38:879-887; Kramer et al., (1988) *Nucl. Acids Res.* 16: 7207; Ling et al., (1997) *Anal Biochem.* 254(2): 157-178; Lorimer and Pastan (1995) *Nucleic Acids Res.* 23, 3067-8; Mandecki (1986) *Proc. Natl. Acad. Sci. USA* 83:7177-7181; Nakamaye and Eckstein (1986) *Nucl. Acids Res.* 14: 9679-9698; Nambiar et al., (1984) *Science* 223: 1299-1301; Sakamar and Khorana (1988) *Nucl. Acids Res.* 14: 6361-6372; Sayers et al., (1988) *Nucl. Acids Res.* 16:791-802; Sayers et al., (1988) *Nucl. Acids Res.* 16:803-814; Sieber et al., (2001) *Nature Biotechnology* 19:456-460; Smith (1985) *Ann. Rev. Genet.* 19:423-462; Stemmer (1994) *Nature* 370, 389-91; Taylor et al., (1985) *Nucl. Acids Res.* 13: 8749-8764; Taylor et al., (1985) *Nucl. Acids Res.* 13: 8765-8787; Wells et al., (1986) *Phil. Trans. R. Soc. Lond. A* 317: 415-423; Wells et al. (1985) *Gene* 34:315-323; Zoller and Smith (1982) *Nucleic Acids Res.* 10:6487-6500; Zoller and Smith (1983) *Methods in Enzymol.* 100:468-500; and Zoller and Smith (1987) *Methods in Enzymol.* 154:329-350. In some examples, the amino acid residues are modified by NNK mutagenesis. In other examples, the amino acid residues are modified by cassette mutagenesis.

In some examples, selected target amino acid residues can be mutagenized individually such that each mutagenesis is performed by the replacement of a single amino acid residue at only one target position, such that each individual mutant generated is the single product of each single mutagenesis reaction. The single amino acid replacement mutagenesis reactions can be repeated for each of the replacing amino acids selected at each of the target positions in the selected region. Thus, a plurality of mutant protein molecules are produced, whereby each mutant protein contains a single amino acid replacement at only one of the target positions. The mutagenesis can be effected in an addressable array such that the identity of each mutant protein is known. For example, site-directed mutagenesis methods can be used to individually generate mutant proteins.

In other examples, a mutagenized antibody can be generated that has random amino acids at specific target positions in the variable heavy or light chain. Generally, selected target amino acid residues can be mutagenized simultaneously, i.e., one or more amino acid residues are mutagenized at the same time. For example, random mutagenesis methodology can be used such that target amino acids are replaced by all (or a group) of the 20 amino acids. Either single or multiple replacements at different amino acid positions are generated on the same molecule, at the same time. In this approach neither the amino acid position nor the amino acid type are restricted; and every possible mutation is generated and tested. Multiple replacements can randomly happen at the same time on the same molecule. The resulting collection of mutant molecules can be assessed for activity as described below, and those that exhibit binding are identified and sequenced.

In random mutagenesis methods, it is contemplated that any known method of introducing randomization into a sequence can be utilized. For example, error prone PCR can introduce random mutations into nucleic acid sequences encoding the polypeptide of interest (see, e.g., Hawkins et al., *J. Mol. Biol.,* (1992) 226(3): 889-96). Briefly, PCR is run under conditions which compromise the fidelity of replication, thus introducing random mutations in sequences as those skilled in the art can accomplish.

Exemplary of a method of introducing randomization into one or more target amino acid positions is the use of a deoxyribonucleotide "doping strategy," which can cover the introduction of all 20 amino acids while minimizing the number of encoded stop codons. For example, NNK mutagenesis can be employed whereby N can be A, C, G, or T (nominally equimolar) and K is G or T (nominally equimolar). In other examples, NNS mutagenesis can be employed whereby S can be G or C. Thus, NNK or NNS (i) code for all the amino acids, (ii) code for only one stop codon, and (iii) reduce the range of codon bias from 6:1 to 3:1. There are 32 possible codons resulting from the NNK motif: 1 for each of 12 amino acids, 2 for each of 5 amino acids, 3 for each of 3 amino acids, and only one of the three stop codons. Other alternatives include, but are not limited to: NNN which can provide all possible amino acids and all stops; NNY which eliminates all stops and still cover 14 of 20 amino acids; and NNR which covers 14 of 20 amino acids. The third nucleotide position in the codon can be custom engineered using any of the known degenerate mixtures. However, the group NNK, NNN, NNY, NNR, NNS covers the most commonly used doping strategies and the ones used herein.

Mutagenized proteins are expressed and assessed for activity to the target antigen. Any method known to one of skill in the art to assess activity, for example, as described further herein below in Section E.1, can be used. For example, exemplary binding assays include, but are not limited to immunoassays such as competitive and non-competitive assay systems using techniques such as western blots, radioimmunoassays, ELISA (enzyme linked immunosorbent assay), "sandwich" immunoassays, Meso Scale Discovery electrochemiluminescence assays (MSD, Gaithersburg, Md.), immunoprecipitation assays, ELISPOT, precipitin reactions, gel diffusion precipitin reactions, immunodiffusion assays, agglutination assays, complement-fixation assays, immunoradiometric assays, fluorescent immunoassays, and protein A immunoassays. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety). For example, in the methods provided herein, binding of an antibody to a target antigen is determined using an ECL binding assay. In another example, binding is determined by ELISA.

Identified mutant antibodies that exhibit improved or increased binding to the target antigen compared to the parent first antibody are identified. The amino acid mutations in the variable heavy or light chain in the identified mutant antibody can be determined. As discussed below, further mutagenesis and iterative screening can be effected on an identified mutant antibody to further optimize the activity for a target antigen. For example, the mutations of all mutant antibodies of a parent first antibody that were identified as exhibiting improved binding for a target antigen can be determined. All or a subset of the identified amino acid mutations can be combined to generate a combination mutant antibody.

2. SAR by Scanning Mutagenesis

Scanning mutagenesis is a simple and widely used technique in the determination of the functional role of protein residues. Scanning mutagenesis can be used in methods of affinity maturation herein to determine SAR of a first antibody. Scanning mutagenesis can be performed on a first antibody without comparison to a related antibody. In other examples, scanning mutagenesis is optionally performed prior to mutagenesis of a target region above in order to more rationally identify amino acif residues to mutate.

In the scanning mutagenesis methods herein, every residue across the full-length of the variable heavy chain and/or variable light chain of the antibody is replaced by a scanning amino acid. Alternatively, every residue in a region of the variable heavy chain or variable light chain is replaced by a scanning amino acid. For example, at least one CDR (e.g. a CDRH1, CDRH2, CDRH3, CDRL1, CDRL2 or CDRL3) is selected for scanning. The scanning amino acid can be any amino acid, but is generally an alanine, theronine, proline or glycine. Amino acid substitution is typically effected by site-directed mutagenesis. Alanine is generally the substitution residue of choice since it eliminates the side chain beyond the [beta] carbon and yet does not alter the main-chain conformation (as can glycine or proline), nor does it impose extreme electrostatic or steric effects. Generally, all amino acid residues selected for mutageneis are scanned (e.g. mutated to) the same amino acid residue. Often, it is necessary to use other scanning amino acid residues. For example, if the target amino acid residue already is an alanine, then another amino acid residue such as threonine, proline or glycine can be used.

When performing scanning mutagenesis, all or a subset of amino acids across the full-length polypeptide or in a selected region are targeted for scanning mutagenesis, for example, 1, 2, 3, 4, 5, 6, 7, 8, 9, 10, 11, 12, 13, 14, 15, 16, 17, 18, 19, 20 or more amino acid residues are subjected to scanning mutagenesis. In examples where scanning mutagenesis is performed in addition to comparison to a related antibody, all amino acid residues in a target region, or a subset or amino acid residues in a target region, are scanned. In one example, only the amino acid residues that differ between the first antibody and a related antibody are targeted for scanning mutagenesis. Generally, all amino acid residues in a target region are subjected to scanning mutagenesis. Mutagenized proteins are expressed and assessed for activity to the target antigen as described above and in Section E below.

Following scanning, scanned (e.g. mutated) antibodies are screened for an activity to identify amino acid residues for further mutation. Generally, most prior art scanning mutagenesis methods involve or are limited to identification of scanned positions that knock down or decrease the activity of the protein of interest. The rationale is that these residues are critical for activity in some way. For purposes of practice of the method herein, however, residues that are "Up" mutants are selected for further mutagenesis following scanning. These are antibodies that exhibit retained or increased activity when mutated to contain a scanned amino acid compared to the parent antibody. Further, only residues with scanned substitutions that are in contact-making CDRs are selected. Thus in an exemplary embodiment, only residues with scanned substitititutions that are in contact-making CDRs and that do not affect activity or confer an improvement are selected herein to further mutate individually to other amino acids.

A benefit of this approach is that generally antibodies that are selected for affinity maturation herein exhibit a micromolar or high nanomolar affinity. Such affinities mean that the antibodies exhibit a low interaction for the target antigen. This is in contrast to many proteins that are typically affinity matured that already are highly evolved for their functional activity. Thus, for antibodies selected for affinity maturation that exhibit a weaker activity for a target antigen, there is more opportunity to improve or optimize weak interactions. Thus, in practicing the method herein, scanned residues that result in an increased or retained activity of the antibody are selected for further mutagenesis. This, allows new interactions to take place, for example, creating new contact residues, that did not exist prior to affinity maturation.

Thus, in scanning mutagenesis methods herein, selected amino acids are subjected to scanning mutagenesis to identify those amino acid residues that are "Up" mutants (i.e. exhibit retained or increased activity). Further mutagenesis is performed only at scanned amino acid positions that exhibit a retained or an increase in activity to the target antigen compared to the parent antibody. An antibody that retains an activity to a target antigen can exhibit some increase or decrease in binding, but generally exhibits the same binding as the first antibody not containing the scanned mutation, for example, exhibits at least 75% of the binding activity, such as 75% to 120% of the binding, for example, 75%, 80%, 85%, 90%, 95%, 100%, 105%, 110% or 115% of the binding. An antibody that exhibits increased activity to a target antigen generally exhibits greater than 115% of the activity, such as greater than 115%, 120%, 130%, 140%, 150%, 200% or more activity than the first antibody not containing the mutation. Thus, scanning mutagenesis can be employed to restrict the subset of target amino acid residues in the target region that are further mutagenized. Once identified, mutagenesis is performed on all or a subset of the amino acid residues as described in Section C.4 above. The further mutagenized antibodies are expressed and assessed for activity to the target antigen as described above and in Section E below. Antibodies that exhibit an improved or optimized activity compared to the first antibody are selected.

3. Further Optimization

The affinity maturation methods provided herein can be performed iteratively to further optimize antibodies. Additionally or alternatively, all or a subset of the amino acid modifications within a variable heavy or light chain that result in improved or increased activity to the target antigen can be selected and combined and further assessed for activity. These intermediate antibodies also can be used as templates for further mutagenesis using the affinity maturation methods herein. In some examples, variable heavy or light chains with one or more amino acid modification(s) incorporated can be used as templates for further mutagenesis and optimization of activity. In addition, further regions of an antibody can be mutagenized.

The method further provides for optimization of regions of the variable heavy or light chain that were not initially selected for mutagenesis based on the amino acid sequence comparison of the first antibody and related antibodies. An additional region selected for further mutagenesis can occur along any portion of the variable heavy or light chain. For example, a further region can include a CDR or a framework region. Typically, a CDR, for example, CDR1, CDR2 and/or CDR3, is selected and targeted. Any one or more of the regions can be targeted for affinity maturation by mutagenesis. As exemplified in Examples 9 and 12 below, CDRH1 and CDRH2 are selected for additional mutagenesis.

Additional regions of the variable heavy or light chain can be subjected to further mutagenesis at the same time, or alternatively, they can be mutagenized iteratively. For example, mutations in one region that optimize an activity of the antibody can first be identified by further mutagenesis herein, followed by optimization of a second region. The selection of amino acid residues to mutagenize within a selected target region can be determined by the person practicing the method. In some examples, all amino acids in that region are targeted for mutagenesis. In other examples, only a subset of amino acids in that region are targeted for mutagenesis. In an additional example, scanning mutagenesis is performed to identify residues that increase or retain activity to the target antigen. In such examples, only residues that increase or do not affect binding affinity are further mutagenized to identify mutations that increase binding affinity to the target antigen. Typically, mutagenesis is performed for one or both of the heavy and/or light chain(s) independently of the other. The amino acid residues that are selected for further mutagenesis can be modified by any method known to one of skill in the art. Mutagenized proteins are expressed and assessed for binding to the target antigen. Exemplary binding assays are described in Section E.1 below.

The amino acid residues in a region that are selected for further mutagenesis can be modified by any method known to one of skill in the art, as described in Sections C.4 and C.5 above. In some examples, the selected amino acids are subjected to scanning mutagenesis to identify "Up" mutants for further mutagenesis. In other examples, the selected amino acids are randomly mutagenized, for example, the amino acid residues are modified by saturation mutagenesis and/or cassette mutagenesis. Mutagenized proteins are expressed and assessed for activity to the target antigen, as described in Sections F and E. Antibodies containing amino acid mutations that increase activity to the target antigen are identified.

Combination mutants also can be generated. In the methods provided herein, amino acid mutations that result in increased activity of the antibody towards the target antigen can be combined to generate a variable heavy or light chain with multiple amino acid modifications. Typically, combination mutants have 2, 3, 4, 5, 6, 7, 8, 9, 10 or more mutations per variable heavy and/or light chain. In some examples, combination mutants contain two amino acid modifications. In other examples, combination mutants contain three or more amino acid modifications. As exemplified in Example 9 below, a variable heavy chain is generated containing 4 amino acid mutations.

In addition, intermediate antibodies containing multiple amino acid modifications within the variable heavy or light chain can be generated at any step in the method. A variable heavy and/or light chain of an intermediate antibody, i.e., one containing multiple previously identified amino acid modifications, can be used as a "template" for further mutagenesis and affinity maturation.

Further, the method herein provides for pairing of any modified heavy chains with any modified light chains thereby generating intermediate or affinity matured antibodies in which both the heavy and light chains contain mutations. Mutated heavy and light chains can be paired at any step in the method, expressed and assessed for binding to the target antigen. Thus, further optimization of an antibody can be achieved.

At any step in of further optimization in the methods herein, the affinity matured antibodies can be further evaluated for activity as described in Section E.

a. Complementarity Determining Regions

In some examples, a region is selected for further mutagenesis. Generally, a region is a CDR, for example, CDR1, CDR2 and/or CDR3 of the variable heavy or light chain. The amino acid residues within a variable heavy or light chain CDR can be identified by one of skill in the art. CDRs can be identified by any standard definition, including those of Kabat (see, e.g., Kabat et al. (1991) Sequences of Proteins of Immunological Interest, Fifth Edition. NIH Publication No. 91-3242.); Chothia (see, e.g. Chothia & Lesk, (1987) *J Mol Biol.* 196(4):901-17; Al-Lazikani et al., (1997) *J Mol Biol.* 273(4):927-48); Abm (see, e.g., Martin et al., (1989) *Proc Natl Acad Sci USA* 86:9268-9272); or contact residues based on crystal structure data (see, e.g., MacCalllum et al., (1996) *J. Mol. Biol.* 262, 732-745) Amino acids contained within heavy and light chain CDRs, as defined based on Kabat numbering, are described in Section C.3. above.

Typically, a CDR contains 3 to 25 residues, all or part of which can be targeted for further mutagenesis. For example, 1, 2, 3, 4, 5, 6, 7, 8, 9, 10, 11, 12, 13, 14, 15, 16, 17, 18, 19, 20, 21, 22, 23, 24, or 25 amino acid residues can be targeted for mutagenesis. As exemplified in Example 9, only selected residues of CDRH1 were mutagenized whereas in Example 10, all residues within CDRL2 were mutagenized.

Selected amino acids are subjected to mutagenesis and the antibodies are expressed and assayed for activity to the target antigen as described in sections C.4 above and E. and F. below.

b. Framework Regions

In some examples, a region selected for further mutagenesis is part of a framework region, for example, FR1, FR2, FR3 and/or FR4, of the variable heavy or light chain. As is the case for CDRs, framework regions can be identified by any standard definition, according to the numbering of Kabat, Chothia, Abm or contact residues Amino acids that make up the framework regions within the heavy and light chain variable regions as defined based on Kabat numbering are described in Section C.3. above. Typically, a framework region contains 11 to 32 amino acids. All or part of a framework region can be targeted for mutagenesis, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or 32 amino acids can be subjected to full or partial saturation mutagenesis. A selected region with a framework region can include one or more amino acid residues. In some examples, only one amino acid residue is mutagenized. In other examples, two or more amino acid residues are mutagenized. Selected amino acid residues can be mutagenized individually, or alternatively, selected amino acid residues can be mutagenized simultaneously, i.e., one or more amino acid residues are mutagenized at the same time. For example, double mutants are generated and assayed for their ability to bind to the target antigen.

Selected amino acids are subjected to mutagenesis and the antibodies are expressed and assayed for activity to the target antigen as described in sections C.4 above and E. and F below.

c. Germline Swapping

In some examples, a region selected for further mutagenesis is a germline segment, i.e., a variable heavy chain V, D or J segment, or a variable kappa or lambda light chain V or J segment, e.g., $V_H$, $D_H$, $J_H$, $V_\kappa$, $V_\lambda$, $J_\kappa$, and $J_\lambda$. In a variable heavy chain, germline segment $V_H$ contains amino acids within CDR1 and CDR2 while germline segments $D_H$ and $J_H$ contain amino acid residues within CDR3. In a variable light chain, V germline segments (e.g., $V_\kappa$ or $V_\lambda$) contain amino acid residues within CDR1, CDR2 and the 5' end of CDR3 while J germline segments (e.g., $V_\lambda$ and $J_\kappa$) contain amino acid residues at the 3' end of CDR3. When a germline segment is targeted for mutagenesis, amino acid modifications are introduced into a variable heavy or light chain by swapping, or replacing, an entire germline segment with another germline segment of the same type. For example, a $J_H$ germline segment, e.g., IGHJ1*01, is replaced with a different $J_H$ germline segment, e.g., IGHJ2*01, or any other IGHJ germline segment. As exemplified in Example 13A and FIG. 4A, swapping of IGHJ1*01 allows for simultaneous mutation of 6 amino acid residues within heavy chain CDR3 and a seventh residue within framework region 4. One germline segment is swapped, such as, for example, $J_H$, or alternatively, two germline segments can be swapped, for example, both $D_H$ and $J_H$ can be swapped within one variable heavy chain.

Typically, a D or J germline segment is selected for mutagenesis since these germline segments encode for CDR3 of both the heavy and light chain. More specifically, germline segments $D_H$, $J_H$, $J_\kappa$, and/or $J_\lambda$ are selected. As exemplified in Example 13B, swapping of both $D_H$ and $J_H$ segments leads to an almost complete scan of heavy chain CDR3. As shown in FIG. 4B, germline segment $J_H$ is swapped with three different $J_H$ segments serving to mutate 6 amino acids at the 3' end of CDRH3 and as shown in FIG. 4C, 5 amino acids within the middle of CDRH3 are modified.

Germline swapped antibodies are expressed and assayed for activity to the target antigen as described in section E. and F below. Antibodies containing swapped germline segments that increase activity to the target antigen can be used as intermediate antibodies for further modifications, as described in this section herein.

D. Method of Antibody Conversion

Provided herein is a method of antibody conversion. The method is based on the elucidation that antibodies with varying affinities, while maintaining their specificity to a target antigen, can exhibit a range of activities ranging from agonist or activator-modulator activity to antagonist activity for the same target antigen. As described herein, the pharmacologic activity of antibodies is dependent on their affinity, with qualitatively different activities (activations vs inhibition) occurring in antibodies recognizing the same epitope but with disparate affinities. It is contemplated herein that activation of an activity is due to the enhancement of signaling through receptor clustering and rapid on/off kinetics of the low affinity variant. In contrast, high affinity binders grab on to their ligand and do not let go, thereby preventing transmission of a signal. Thus, an antibody can have a therapeutic benefit as a low affinity agonist or activator-modulator or as a high affinity antagonist of the same target antigen.

Nearly all antibodies in clinical use are high-affinity antagonists, despite the fact that multiple mechanisms of action are typically seen for several classes of small molecule drugs. For example, small molecule drugs have several mechanisms of action, including acting as antagonists, agonists, partial agonists or antagonists and modulators. In contrast, most antibody therapeutics act as antagonists. The discovery selection mechanisms in hybridoma and display-based systems drive affinity and dominant epitope binding Thus, most methods of antibody engineering exhibit affinity-based bias. This is because most existing display-based libraries select antibodies based on the ability to rapidly identify high-affinity binders. For example, most methods rely on competitive selection based on target affinity. Thus, most existing methods, for example, traditional display-based methods that rely on competitive affinity screens can miss potential therapeutics simply because they are incompatible with high affinity.

Thus, provided herein are methods of antibody conversion, whereby antibodies are converted from antagonists to partial agonists, antagonists or activators-modulators, or can be converted from agonists or activators-modulators to antagonists or partial antagonists. The method is based on converting antibodies by modulating or altering the binding affinity of an antibody for the same target antigen in order to get a range of activities from antagonism, partial antagonism or activation-modulation. The methods combine mutagenesis approaches of a starting antibody with endpoint analysis for binding affinity and functional activity assessment of resulting activities. By employing random or rational mutagenesis strategies, libraries can be generated that can be screened through a wide dynamic range of affinities to identify antibodies with antagonist, partial antagonist or activator/modulator activities. In some examples, the libraries are in arrayed formats such that the identity of each member in the library is known. In another example, a structure/activity relationship (SAR) mutagensis strategy can be employed similar to the affinity maturation method described in Section C.

1. Choosing the Starting or Reference Antibody

In the method, a starting or reference antibody, or portion thereof, to be converted is chosen. The antibody that is chosen is one that 1) exhibits a known activity against a particular target antigen (e.g. antagonist or agonist), and 2) for which there would be a potential therapeutic benefit if the activity of the antibody was inversed or partially inversed. For example, an antibody that exhibits an antagonist or partial antagonist activity can be chosen, whereby an antibody exhibiting the inverse agonist, partial agonist or activator-modulator activity towards the same target antigen also is desired. In another example, an antibody that exhibits an agonist, partial agonist or activator-modulator activity towards a target antigen can be chosen, whereby an antibody exhibiting the inverse antagonist or partial antagonist activity towards the same target antigen also is desired.

The first or starting antibody is an antibody that is known or that is identified as having an activity to a target antigen. The target antigen can be a polypeptide, carbohydrate, lipid, nucleic acid or a small molecule (e.g. neurotransmitter). The antibody can exhibit activity for the antigen expressed on the surface of a virus, bacterial, tumor or other cell, or exhibits an activity (e.g. binding) for the purified antigen. Generally, the target antigen is a protein that is a target for a therapeutic intervention. Exemplary target antigens include, but are not limited to, targets involved in cell proliferation and differentiation, cell migration, apoptosis and angiogenesis. Such targets include, but are not limited to, growth factors, cytokines, lymphocytic antigens, other cellular activators and receptors thereof. Exemplary of such targets include, membrane bound receptors, such as cell surface receptors, including, but are not limited to, a VEGFR-1, VEGFR-2, VEGFR-3 (vascular endothelial growth factor receptors 1, 2, and 3), a epidermal growth factor receptor (EGFR), ErbB-2, ErbB-b3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epidermal growth factor homology domains receptor), CSF1R (colony stimulating factor 1 receptor), PDGFRB (platelet-derived growth factor receptor B), EPHA1, EPHA2, EPHB 1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R and EPO-R. Other targets include membrane-bound proteins such as selected from among a cadherin, integrin, CD52 or CD44. Exemplary ligands that can be targets, include, but are not limited to, VEGF-A, VEGF-B, VEGF-C, VEGF-D, PIGF, EGF, HGF, TNF-α, LIGHT, BTLA, lymphotoxin (LT), IgE, G-CSF, GM-CSF and EPO.

The first or starting antibody that has activity for the target antigen is known in the art or is identified as having a particular activity for a target antigen or antigens. For example, any method for identifying or selecting antibodies against particular target antigens can be used to choose or select a starting antibody including, but not limited to, immunization and hybridoma screening approaches, display library screening methods (e.g. antibody phage display libraries), or addressable combinatorial antibody libraries. For example, methods of identifying antibodies with particular activities or affinities is described in Section B.2 herein. Further, it is understood that the description of the methods for choosing or selecting a first or starting antibody described for the affinity maturation method herein in Section C.1, and in particular in section C.1.ai and ii, can also be used choose or select a first antibody to be converted in the antibody conversion method herein. In addition, any antibody that has been affinity matured, and which, typically, exhibits antagonist activity, can be selected as the starting or first antibody. As discussed elsewhere herein, affinity maturation methods are known in the art (see e.g. Section B.3). Also, the affinity maturation method described in Section C also can be used to identify an antibody, generally one with high affinity, that can be subsequently used in the conversion method herein.

If not known, the activity of a first or starting antibody can be determined. The binding affinity and/or functional activity (e.g. as an agonist, antagonist or activator-modulator) can be determined Exemplary assays are described herein in Section E and in the Examples. The particular assay chosen depends on the target antigen and/or its requirements for activity. For example, DLL4 is a cell-surface ligand that activates the Notch1 receptor, also expressed on the cell surface. Thus, typically, cell-based assays are employed to assess activity. Exemplary of cell-based assays are reporter assays as described herein and in the Examples. Based on the descriptions herein, it is within the level of one of skill in the art to determine and or optimize a particular assay for each antibody.

2. Mutagenesis

Once a first or starting antibody is chosen, amino acid residues in the variable heavy chain and/or variable light chain are subjected to mutagenesis. Generally, amino acid residues in a CDR or CDRs are mutated, for example, residues in CDRL1, CDRL2, CDRL3, CDRH1, CDRH2 and/or CDRH3 of the antibody are mutated. For example, typically, a CDR can contain 3 to 25 amino acid residues. All or subset of the amino acids within a CDR can be targeted for mutagenesis, for example, 1, 2, 3, 4, 5, 6, 7, 8, 9, 10, 11, 12, 13, 14, 15, 16, 17, 18, 19, 20, 21, 22, 23, 24, or 25 amino acid residues can be targeted for mutagenesis.

The amino acid residues that are selected for further mutagenesis can be modified by any method known to one of skill in the art. The amino acid residues can be modified rationally or can be modified by random mutagenesis. This can be accomplished by modifying the encoding DNA. One of skill in the art is familiar with mutagenesis methods. For example, any of the mutagenesis methods described in Section C.1.d can be used. In one example, if residues in the first or starting antibody are known that are involved in binding, those residues can be rationally targeted by any of a variety of mutagenesis strategies. In another example, random mutagenesis methods can be employed. Exemplary of such mutagenesis strategies introduce randomization into a sequence using methods know in the art, including but not limited to, error prone PCR or doping strategies. Mutagenized proteins are expressed as described in Section F. Libraries or collections of variant antibodies can be generated and screened for conversion as described herein below. In some examples, the libraries are addressable libraries.

3. Selecting for a Converted Antibody

Mutagenized proteins are expressed and assessed for their binding affinity to the target antigen and/or for effects on modulation of a functional activity towards the target antigen. Converted antibodies are selected for that have a binding affinity and activity that is inversed (e.g. higher or lower; antagonist vs. agonist/activator-modulator) compared to the starting of first antibody.

a. Binding

In the first step of selection of a converted antibody, binding affinity is assessed. Any method known to one of skill in the art to assess activity, for example, as described further herein below in Section E.1, can be used. For example, exemplary binding assays include, but are not limited to immunoassays such as competitive and non-competitive assay systems using techniques such as western blots, radioimmunoassays, ELISA (enzyme linked immunosorbent assay), "sandwich" immunoassays, Meso Scale Discovery electrochemiluminescence assays (MSD, Gaithersburg, Md.), immunoprecipitation assays, ELISPOT, precipitin reactions, gel diffusion precipitin reactions, immunodiffusion assays, agglutination assays, complement-fixation assays, immunoradiometric assays, fluorescent immunoassays, and protein A immunoassays. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety). For example, in the methods provided herein, binding of an antibody to a target antigen is determined using an ECL binding assay. In another example, binding is determined by ELISA. As discussed elsewhere herein, comparison of binding affinities between a first antibody and a mutagenized antibody are typically made between antibodies that have the same structure, e.g. Fab compared to Fab of IgG compated to IgG.

For example, if an antagonist antibody is chosen as the first or starting antibody, an agonist, partial agonist or activator-modulator is selected by first testing the antibody for its binding affinity. Antibodies that exhibit a decreased binding affinity (e.g. higher binding affinity) than the first or starting antibody are selected. For example, antibodies are selected that exhibit a binding affinity that is decreased by 2-fold to 5000-fold, for example, 10-fold to 5000-fold, such as 100-fold to 1000-fold. For example, if the binding affinity of the first or starting antibody is $10^{-9}$ M, and antibody exhibiting a binding affinity of $10^{-7}$ M exhibits a 1000-fold decreased binding affinity.

In another example, if an agonist, partial agonist, or an activator-modulator antibody is chosen as the first or starting antibody, an antagonist or partial antagonist antibody is selected by first testing the antibody for its binding affinity. Antibodies that exhibit an enhanced or increased binding affinity (e.g. lower binding affinity) then the first or starting antibody are selected. For example, antibodies are selected that exhibit a binding affinity that is enhanced or increased by 10-fold to 10,000 fold, for example, 100-fold to 5000-fold, such as about 500-fold to 2500-fold. For example, if the binding affinity of the first or starting antibody is $10^{-7}$ M, an antibody exhibiting a binding affinity of $10^{-9}$ M is selected as exhibiting a 1000-fold increased or enhanced binding affinity.

b. Functional Activity

Mutagenized antibodies initially selected based on binding affinity are then selected for the inversed modulation of a functional activity. Assays to assess the functional activities are well known to those of skill in the art and can be empirically determined depending on the particular target protein. Typically, the assay is a cell-based assay. Exemplary assays, including exemplary cell lines, are described herein in Section E. The cells to be assayed express the particular target protein of interest. Control cells not expressing the protein also can be used to assess specificity. The assay that is employed is one that is capable of providing a read-out that that provides a quantitative assessment of activity, which can be readily assessed. For example, exemplary functional assays include reporter assays, whereby upon activation of a cell-surface receptor, for example by an exogenously added ligand, a reporter signal is induced that can be measured. In the presence of an antagonist or partial antagonist antibody to the cell-surface receptor or ligand, the measured read-out is decreased consistent with the inhibitory effect of the antibody. In contrast, in the presence of an agonist, partial agonist or activator-modulator, the measured read-out is increased consistent with an activating effect of the antibody.

For example, if the starting or first antibody is an antagonist of a target protein, mutant antibodies of the first antibody that are initially selected as having decreased binding affinity in a) above (e.g. higher binding affinity), are further tested for activity as an agonist, partial agonist and/or activator-modulator for the same target protein. Antibodies selected as being converted are those that exhibit an activating activity on the target protein. Thus, the presence of the antibody results in increased activity of the target protein, or on the end-point activity of the target protein, compared to the activity that is exhibited under the same activating conditions without the antibody present. For example, if a target protein is normally activated in the presence of a ligand, a set measured activity is achieved; in the additional presence of an agonist, partial agonist or activator-modulator antibody, the measured activity is increased. In another example, if the target protein is a ligand that normally activates a receptor, the ligand-receptor interaction results in a set measured activity; in the additional presence of an antibody to the ligand the measured activity is increased. For example, activity of the target protein is increased by 1.2 to 2-fold, 2-fold to 1000-fold, for example, is increased 5-fold to 500-fold, such as 10-fold to 200-fold, for example, is increased 1.2-fold, 1.5-fold, 2-fold, 5-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to the activity of the target protein under the same activating conditions without the antibody present.

In another example, if the starting or first antibody is an agonist, partial agonist or activator-modulator of a target protein, mutant antibodies of the first antibody that are initially selected as having increased or enhanced binding affinity in a) above (e.g. lower binding affinity), are further tested for activity as an antagonist or partial antagonist for the same target protein. Antibodies selected as being converted are those that exhibit an inhibitory activity on the target protein. Thus, the presence of the antibody results in decreased activity of the target protein, or on the end-point activity of the target protein, compared to the activity that is exhibited under the same activating conditions without the antibody present. For example, if a target protein is normally activated in the presence of a ligand, a set measured activity is achieved; in the additional presence of an antagonist or partial antagonist antibody, the measured activity is decreased. In another example, if the target protein is a ligand that normally activates a receptor, the ligand-receptor interaction results in a set measured activity; in the additional presence of an antibody to the ligand the measured activity is decreased. For example, activity of the target protein is decreased by 1.2 to 2-fold, 2-fold to 1000-fold, for example, is decreased by 5-fold to 500-fold, such as 10-fold to 200-fold, for example, is deceased 1.2-fold, 1.5-fold, 2-fold, 5-fold, 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1000-fold or more compared to the activity of the target protein under the same activating conditions without the antibody present.

In some examples of the antibody conversion method herein, the initial step of selecting an antibody based on an increased or decreased binding affinity is not performed. Hence, the method of antibody conversion herein can be effected directly by choosing a first or starting antibody as described herein, mutagenizing it as described herein, and directly testing the collection of mutant antibodies for an inverse functional activity of the first or starting antibody. Converted antibodies are selected that exhibit the inverse activity.

In practicing the method provided herein, typically only the variable heavy chain and/or variable light chain of the antibody is subjected to mutagenesis. The ultimate antibody that is selected typically at least contains a variable heavy chain and a variable light chain, or portion thereof sufficient to form an antigen binding site. It is understood, however, that the antibody also can include all or a portion of the constant heavy chain (e.g. one or more CH domains, such as CH1, CH2, CH3 and CH4, and/or a constant light chain (CL)). Hence, the antibody can include those that are full-length antibodies, and also include fragments or portions thereof including, for example, Fab, Fab', F(ab')$_2$, single-chain Fvs (scFv), Fv, dsFv, diabody, Fd and Fd' fragments, Fab fragments, scFv fragments, and scFab fragments. It also is understood that once the antibody is converted as provided herein, the resulting antibody can be produced as a full-length antibody or a fragment thereof, such as a Fab, Fab', F(ab')$_2$, single-chain Fvs (scFv), Fv, dsFv, diabody, Fd and Fd' fragments, Fab fragments, scFv fragments, and scFab fragments. Further, the constant region of any isotype can be used in the generation of full or partial antibody fragments, including IgG, IgM, IgA, IgD and IgE constant regions. Such constant regions can be obtained from any human or animal species. It is understood that activities and binding affinities can differ depending on the structure of an antibody, although it is not expected that an activity as, for example an agonist or antagonist, will substantially change. For example, generally a bivalent antibody, for example a bivalent F(ab')$_2$ fragment or full-length IgG, has a better binding affinity then a monovalent Fab antibody. As a result, where a Fab has a specified binding affinity for a particular target, it is excepted that the binding affinity is even greater for a full-length IgG that is bivalent.

The resulting converted antibodies are candidate therapeutics. Exemplary of practice of the method is described herein in the Examples. For example, Example 19 shows that two different anti-DLL4 germline antibodies, having low affinity for DLL4, exhibited agonist activity. Mutagenesis of each of the antibodies by the affinity maturation method described herein resulted in conversion of the antibodies to antagonist antibodies with higher affinity for the same target antigen.

E. Assays

Antibodies produced in the methods herein can be assessed for their activity towards the target antigen. Antibodies can be screened to identify mutant or modified antibodies that have improved binding affinity or that alter or modulate (increase or decrease) an activity of a target. Typically, the methods herein includes screening or testing antibodies for their binding to a target antigen. Other activities also can be assayed for, including but not limited to cytotoxicity, differentiation or proliferation of cells, cell migration, apoptosis, angiogenesis and alteration of gene expression.

1. Binding Assays

The antibodies provided herein can be screened for their ability to bind a selected target by any method known to one of skill in the art. Exemplary target antigens are described in Section C.1. Binding assays can be performed in solution, suspension or on a solid support. For example, target antigens can be immobilized to a solid support (e.g. a carbon or plastic surface or chip) and contacted with antibody. Unbound antibody or target protein can be washed away and bound complexes can then be detected. Binding assays can be performed under conditions to reduce nonspecific binding, such as by using a high ionic strength buffer (e.g. 0.3-0.4 M NaCl) with nonionic detergent (e.g. 0.1% Triton X-100 or Tween 20) and/or blocking proteins (e.g. bovine serum albumin or gelatin). Negative controls also can be including in such assays as a measure of background binding. Binding affinities can be determined using Scatchard analysis (Munson et al., *Anal. Biochem.*, 107:220 (1980)), BIACore or other methods known to one of skill in the art.

Exemplary binding assays include, but are not limited to immunoassays such as competitive and non-competitive assay systems using techniques such as western blots, radioimmunoassays, ELISA (enzyme linked immunosorbent assay), "sandwich" immunoassays, Meso Scale Discovery (MSD, Gaithersburg, Md.), immunoprecipitation assays, ELISPOT, precipitin reactions, gel diffusion precipitin reactions, immunodiffusion assays, agglutination assays, complement-fixation assays, immunoradiometric assays, fluorescent immunoassays, and protein A immunoassays. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety). Other assay formats include liposome immunoassays (LIA), which use liposomes designed to bind specific molecules (e.g., antibodies) and release encapsulated reagents or markers. The released chemicals are then detected according to standard techniques (see Monroe et al., (1986) *Amer. Clin. Prod. Rev.* 5:34-41).

Generally, binding is detected using a detectable moiety or label (e.g. an enzyme, a radionuclide, a fluorescent probe, electrochemiluminescent label, or a color dye) typically attached to the target or, if desired, directly to the antibody members in the library. Alternatively, binding can be detected by a further third reagent that itself is labeled or detectable. For example, detection of an antibody bound to a target protein can be achieved using a labeled capture molecule in a sandwich assay format. Other proteins capable of specifically binding immunoglobulin constant regions, such as protein A or protein G also can be used as the label agent. These proteins exhibit a strong non-immunogenic reactivity with immunoglobulin constant regions from a variety of species (see, e.g., Kronval et al., (1973) *J. Immunol.* 111:1401-1406; Akerstrom et al., (1985) *J. Immunol.* 135:2589-2542). The detection agent can be modified with a detectable moiety, such as biotin, to which another molecule can specifically bind, such as streptavidin. A variety of detectable moieties are well known to those skilled in the art.

The choice of label or detectable group used in the assay is not critical, as long as it does not significantly interfere with the specific binding of the antibody used in the assay. Generally, the choice depends on sensitivity required, ease of conjugation with the compound, stability requirements, available instrumentation, and disposal provisions. One of skill in the art is familiar with labels and can identify a detectable label suitable for and compatible with the assay employed.

The detectable group can be any material having a detectable physical or chemical property. Such detectable labels have been well-developed in the field of immunoassays and, in general, most any label useful in such methods can be applied herein. Thus, a label is any composition detectable by spectroscopic, photochemical, biochemical, immunochemical, electrical, optical or chemical means. Useful labels include magnetic beads (e.g., DYNABEADS™), fluorescent dyes (e.g., fluorescein isothiocyanate, Texas red, rhodamine, and the like), radiolabels (e.g., 3H, 125I, 35S, 14C, or 32P), enzymes (e.g., horse radish peroxidase, alkaline phosphatase and others commonly used in an ELISA), chemiluminescent labels (luciferin and 2,3-dihydrophtahlazinediones, e.g., luminol), and colorimetric labels such as colloidal gold or colored glass or plastic beads (e.g., polystyrene, polypropylene, latex, etc.). For a review of various labeling or signal producing systems that can be used, see e.g. U.S. Pat. No. 4,391,904.

Means of detecting labels are well known to those of skill in the art. Thus, for example, where the label is a radioactive label, means for detection include a scintillation counter or photographic film as in autoradiography. Where the label is a fluorescent label, it can be detected by exciting the fluorochrome with the appropriate wavelength of light and detecting the resulting fluorescence. The fluorescence can be detected visually, by the use of electronic detectors such as charge coupled devices (CCDs) or photomultipliers and the like. Similarly, enzymatic labels can be detected by providing the appropriate substrates for the enzyme and detecting the resulting reaction product. Finally simple colorimetric labels can be detected simply by observing the color associated with the label.

Some assay formats do not require the use of labeled components. For instance, agglutination assays can be used to detect the presence of the target antibodies. In this case, antigen-coated particles are agglutinated by samples containing the target antibodies. In this format, none of the components need be labeled and the presence of the target antibody is detected by simple visual inspection.

Alternatively, the antibodies provided herein can be screened for their ability to bind to cells, using whole cell panning, with or without subtractive panning. Screening can be done against live cells or against intact, mildly fixed target cells. Methods for whole cell panning have been described previously (see e.g. Siegel et al. (1997) *J. Immunol. Methods* 206:73-85 incorporated herein by reference). Other techniques for screening which can be applied include fluorescent activated cell sorting (FACs).

For high-throughput screening, assays can be multiplexed. Thus, the binding affinities of antibodies to a number of different target proteins can be determined at once. In one example, different target proteins can be separately labeled with different detectable moieities. For example, different antigens can be coupled to color-coded beads (Schwenk et al. (2007) Mol. Cell. Prot., 6:125-132). In another example, multi-spot plates can be used that permit assay multiplexing by absorption of up to 100 proteins in a locus of the plate (e.g. using Multi-Array or Multi-Spot plates from Meso Scale Discovery; MSD, Gaithersburg, Md.). In such an example, antibodies can be screened by addition of a different antibody to each well of a multi-spot plate. The assay readily permits the screening of thousands of antibodies at once against numerous target proteins.

In the methods of screening herein, antibodies generally are identified that specifically bind to a target antigen, and that have an increased binding affinity compared to a first antibody. The increase in affinity, measured as decrease in Kd, can be achieved either through an increase in association rate ($k_{on}$), or a reduction in dissociation rate $k_{off}$ or both. For example, the binding affinity of the antibodies is determined to identify or select antibodies that have high affinity for a target protein. For example, the affinity matured antibodies generated by practice of the method can have a binding affinity for a target antigen that is $1\times10^{-9}$ M or less, generally $1\times10^{-9}$ M to $1\times10^{-11}$ M, for example that is or is about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $6\times10^{-10}$ M, $7\times10^{-10}$ M, $8\times10^{-10}$ M, $9\times10^{-10}$ M or less.

Any method known to one of skill in the art can be used to measure the binding affinity of an antibody. For example, the binding properties of an antibody can be assessed by performing a saturation binding assay, for example, a saturation ELISA, whereby binding to a target protein is assessed with increasing amounts of antibody. In such experiments, it is possible to assess whether the binding is dose-dependent and/or saturable. In addition, the binding affinity can be extrapolated from the 50% binding signal.

Typically, apparent binding affinity is measured in terms of its association constant (Ka) or dissociation constant (Kd) and determined using Scatchard analysis (Munson et al., *Anal. Biochem.*, 107:220 (1980). For example, binding affinity to a target protein can be assessed in a competition binding assay in where increasing concentrations of unlabeled protein is added, such as by radioimmunoassay (RIA) or ELISA. Binding affinity also can be analyzed using BIAcore kinetic analysis. This involves analyzing the binding and dissociation of an antibody member from chips containing immobilized target proteins on their surface. The Biacore evaluation software generates the values of Ka and Kd by fitting the data to interaction models. It is understood that the binding affinity of an antibody can vary depending on the assay and conditions employed, although all assays for binding affinity provide a rough approximation. By performing various assays under various conditions it is possible to estimate the binding affinity of an antibody.

In addition, binding affinities can differ depending on the structure of an antibody. For example, generally a bivalent antibody, for example a bivalent F(ab')2 fragment or full-length IgG, has a better binding affinity then a monovalent Fab antibody. Hence, it is understood that where a Fab has a specified binding affinity for a particular target, it is excepted that the binding affinity is even greater for a full-length IgG that is bivalent.

2. Functional Activity

The antibodies generated by the method herein can be screened for their ability to modulate the functional activity of a target by any method known to one of skill in the art. Assays can be designed to identify antibodies capable of binding and/or modulating cell surface receptors. Such antibodies can either be agonists, mimicking the normal effects of receptor binding, or antagonists, inhibiting the normal effects of receptor binding. Of particular interest is the identification of agents which bind to the receptors and modulate intracellular signaling.

In some example, such assays are cell-based assays. Generally, assays are performed using cell lines known to express the target of interest. Such cells are known to one of skill in the art. For example, one can consult the ATCC Catalog (atcc.org) to identify cell lines. Also, if a particular cell type is desired, the means for obtaining such cells, and/or their instantly available source is known to those in the art. An analysis of the scientific literature can readily reveal appropriate choice of cells expressing any desired target. Table 5 lists exemplary cells lines that express targets of interest that can be screened in functional activities herein against antibody libraries provided herein.

TABLE 5

Cell lines expressing targets

| Target | Cell Lines | References |
|---|---|---|
| GP IIb/IIIa | MEG-01 chronic myelogenous leukemia megakaryoblast cells (ATCC CRL-2021); UT-7 human leukemia cell ine | Ogura et al. Establishment of a novel human megakaryoblastic leukemia cell line, MEG-01, with positive Philadelphia chromosome. Blood 66: 1384-1392, 1985; Komatsu et al. Establishment and Characterization of a Human Leukemic Cell Line with Megakaryocytic Features: Dependency on Granulocyte-Macrophage Colony-stimulating Factor, Interleukin 3, or Erythropoietin for Growth and Survival. Cancer Research 51: 341-348 (1991) |
| GM-CSF-R | VA-ES-BJ epitheloid sarcoma cells (ATCC CRL-2138); TF1-HaRas; TF1-vRaf; TF1-vSrc; HL-60 (ATCC CCL-240); U-937 (ATCC CRL-1593.2); ML-2 | Int J Oncol 1995; 7: 51-56; Ali Habib et al. A urokinase-activated recombinant diphtheria toxin targeting the granulocyte-macrophage colony-stimulating factor receptor is selectively cytotoxic to human acute myeloid leukemia blasts. Blood 104(7): 2143-2148 (2004); Kiser et al. Oncogene-dependent engraftment of human myeloid leukemia cells in immunosuppressed mice. Leukemia 15(5): 814-818 (2001) |
| VEGFA | Human A673 rhabdomyosarcoma cells (ATCC CRL-1598); Breast carcinoma MDA-MB-435 cells (ATCC); Bovine adrenal cortex-derived capillary endothelial cells | Gerber et al. Complete inhibition of rhabdomyosarcoma xenograft growth and neovascularization requires blockade of both tumor and host vascular endothelial growth factor. Cancer Res. 60(22): 6253-8 (2000); Presta et al. Humanization of an anti-vascular endothelial growth factor monoclonal antibody for the therapy of solid tumors and other disorders. Cancer Research, 57(20): 4593-4599 (1997) |
| CD3 | Jurkat E6.1 Human leukemic T cell lymphoblast (Sigma Aldrich 88042803) | Buhler et al. A bispecific diabody directed against prostate-specific membrane antigen and CD3 induces T-cell mediated lysis of prostate cancer cells. Cancer Immunol Immunother. 57(1): 43-52 (2008) |
| EGFR | DiFi human colorectal carcinoma cells; A431 cells (ATCC CRL-1555); Caco-2 colorectal adenocarcinoma cells (ATCC HTB-37); HRT-18 colorectal adenocarcinoma cells (ATCC CCL-244); HT-29 colorectal adenocarcinoma cells (ATCC HTB-38) | Olive et al. Characterization of the DiFi rectal carcinoma cell line derived from a familial adenomatous polyposis patient. In Vitro Cell Dev Biol. 29A(3 Pt 1): 239-248 (1993); Wu et al. Apoptosis induced by an anti-epidermal growth factor receptor monoclonal antibody in a human colorectal carcinoma cell line and its delay by insulin. Clin. Invest. 95(4): 1897-1905 (1995) |

TABLE 5-continued

Cell lines expressing targets

| Target | Cell Lines | References |
|---|---|---|
| EPO receptor | A2780 ovarian cancer cells; UT-7 human leukemia cell ine | Jeong et al. Characterization of erythropoietin receptor and erythropoietin expression and function in human ovarian cancer cells. Int J Cancer. 122(2): 274-280 (2008); Elliott et al. Activation of the Erythropoietin (EPO) Receptor by Bivalent Anti-EPO Receptor Antibodies. J Biol Chem. 271(40): 24691-24697 (1996) |
| Her2/Neu receptor | BT-474 ductal carcinoma breast cancer cell (ATCC HTB-20); SK-BR-3 adenocarcinoma breast cancer cell (ATCC HTB-30); MDA-MB-453 metastatic carcinoma cell line (ATCC HTB-131) | Le et al. Roles of human epidermal growth factor receptor 2, c-jun NH2-terminal kinase, phosphoinositide 3-kinase, and p70 S6 kinase pathways in regulation of cyclin G2 expression in human breast cancer cells. Mol Cancer Ther. 6(11): 2843-2857 (2007) |
| cMet | H1993 lung adenocarcinoma cells (ATCC CRL-5909); H1838 lung adenocarcinoma cells (ATCC CRL-5899); SW 900 lung squamous cell carcinoma cells (ATCC HTB-59); H358 lung bronchioalveolar carcinoma cells (ATCC CRL-5807); SK-Lu-1 lung adenocarcinoma cells (ATCC HTB-57); H441 Non-small cell lung cancer cells (ATCC HTB-174) | Ma et al. Functional expression and mutations of c-Met and its therapeutic inhibition with SU11274 and small interfering RNA in non-small cell lung cancer. Cancer Res. 65(4): 1479-1488 (2005); Ma et al. A selective small molecule c-MET Inhibitor, PHA665752, cooperates with rapamycin. Clin Cancer Res 11(6): 2312-2319 (2005) |
| CD20 | Ramos Burkitt's lymphoma B cells (ATCC CRL-1596); Raji Burkitt's lymphoma B cells (ATCC CCL-86); Daudi Burkitt's lymphoma B cells (ATCC CCL-213); 2F7 Burkitt's lymphoma B cells | Jazirehi et al. Rituximab (anti-CD20) selectively modifies Bcl-xL and apoptosis protease activating factor-1 (Apaf-1) expression and sensitizes human non-Hodgkin's lymphoma B cell lines to paclitaxel-induced apoptosis. Mol Cancer Ther. 2(11): 1183-1193 (2003) |

In addition, cells lines expressing a target of interest can be generated by transient or stable transfection with an expression vector expressing a target of interest. Methods of transfection and expression are known to those of skill in the art (see e.g., Kaufman R. J. (1990) Methods in Enzymology 185:537-566; Kaufman et al. (1990) Methods in Enzymology 185:537-566). In addition, any primary cell or cell line can be assessed for expression of a particular target (e.g. cell surface marker). Cell surface markers can be assayed using fluorescently labeled antibodies and FACS. Suitable cell lines include A549 (lung), HeLa, Jurkat, BJAB, Colo205, H1299, MCF7, MDA-MB-231, PC3, HUMEC, HUVEC, and PrEC.

Any suitable functional effect can be measured, as described herein. For example, cellular morphology (e.g., cell volume, nuclear volume, cell perimeter, and nuclear perimeter), ligand binding, substrate binding, nuclease activity, apoptosis, chemotaxis or cell migrations, cell surface marker expression, cellular proliferation, GFP positivity and dye dilution assays (e.g., cell tracker assays with dyes that bind to cell membranes), DNA synthesis assays (e.g., 3H-thymidine and fluorescent DNA-binding dyes such as BrdU or Hoechst dye with FACS analysis) and nuclear foci assays, are all suitable assays to identify potential modulators using a cell based system. Other functional activities that can be measured include, but are not limited to, ligand binding, substrate binding, endonuclease and/or exonuclease activity, transcriptional changes to both known and uncharacterized genetic markers (e.g., northern blots), changes in cell metabolism, changes related to cellular proliferation, cell surface marker expression, DNA synthesis, marker and dye dilution assays (e.g., GFP and cell tracker assays), contact inhibition, tumor growth in nude mice, and others.

For example, antibodies generated by the method provided herein can be assessed for their modulation of one or more phenotypes of a cell known to express a target protein. Phenotypic assays, kits and reagents for their use are well known to those skilled in the art and are herein used to screen antibody libraries. Representative phenotypic assays, which can be purchased from any one of several commercial vendors, include those for determining cell viability, cytotoxicity, proliferation or cell survival (Molecular Probes, Eugene, Oreg.; PerkinElmer, Boston, Mass.), protein-based assays including enzymatic assays (Panvera, LLC, Madison, Wis.; BD Biosciences, Franklin Lakes, N.J.; Oncogene Research Products, San Diego, Calif.), cell regulation, signal transduction, inflammation, oxidative processes and apoptosis (Assay Designs Inc., Ann Arbor, Mich.), triglyceride accumulation (Sigma-Aldrich, St. Louis, Mo.), angiogenesis assays, tube formation assays, cytokine and hormone assays and metabolic assays (Chemicon International Inc., Temecula, Calif.; Amersham Biosciences, Piscataway, N.J.).

Cells determined to be appropriate for a particular phenotypic assay (i.e., A549, HeLa, Jurkat, BJAB, Colo205, H1299, MCF7, MDA-MB-231, PC3, HUMEC, HUVEC, and PrEC and any others known to express the target of interest) are treated with antibodies as well as control compounds. If necessary, a ligand for the receptor target is included so that activation of the receptor is effected. At the end of the treatment period, treated and untreated cells are analyzed by one or more methods specific for the assay to determine phenotypic outcomes and endpoints.

Phenotypic endpoints include changes in cell morphology over time or treatment dose as well as changes in levels of cellular components such as proteins, lipids, nucleic acids, hormones, saccharides or metals. Measurements of cellular status which include pH, stage of the cell cycle, intake or excretion of biological indicators by the cell, are also endpoints of interest.

The assays can be performed to assess the direct effects of an antibody on a target protein. For example, if the target protein is a cell surface receptor, an antibody can be added to assess whether the target protein directly modulates, such as by stimulation, the activity or function of the receptor. In such instances, the antibody is deemed an agonist antibody. In other examples, if the target protein is a cell surface receptor, the activity of the receptor can be stimulated in the presence of a ligand or other stimulating agent in the presence or absence of the antibody to determine if the antibody modulates (e g inhibits) the actions of the antibody. For example, the antibody can act by blocking the ability of the ligand to interact with the receptor and/or otherwise induce a negative stimulatory signal. In such instances, the antibody is deemed to be an antagonist of the receptor. Thus, the methods of screening herein by functional activity permits identification of agonist and antagonist antibodies.

a. Differentiation

Cellular differentiation can be analyzed using any assay that allows a detection of a physical, chemical or phenotypic change. Various assays are used to quantitatively determine cellular proliferation and activation in response to an external stimuli. Cell proliferation assays are used to quantitatively determine cellular proliferation by incorporating a reagent into the DNA of newly synthesized cells upon cell division. Such reagents include, but are not limited to $^3$H-thymidine, 5-bromo-2'-deoxyuridine (BrdU) and fluorescent Hoechst dyes. Cell viability assays are used to determine the number of healthy cells in a sample by staining cells with a dye and measuring how many cells uptake the dye based on the fact that living cells will exclude the dye. Such dyes include but are not limited to 3-(4,5-dimethylthiazol-2-yl)-2,5-diphenyltetrazolium bromide (MTT), 2,3-Bis(2-methoxy-4-nitro-5-sulfophenyl)-2H-tetrazolium-5-carboxanilide inner salt (XTT), and 4-[3-(4-iodophenyl)-2-(4-nitrophenyl)-2H-5-tetrazolio]-1,3-benzene disulfonate (WST-1). Uptake of the reagent is measured either colorimetrically using a spectrophotometer or by measuring radiation with a scintillation counter. Details of these methods are well-known to one skilled in the art.

Fluorescent dyes are commonly used for the detection of live cells and key functional activities in a variety of cell-based assays. There are several non-radioactive, fluorescence-based assays that are not dependent on cellular metabolism. The fluorescent dye binds nucleic acids and the fluorescence can then be measured quantitatively or qualitatively. Such dyes include, but are not limited to, propidium iodide and Hoechst 33342. The cell number can then be quantitated based on the fluorescence. DNA content can also be quantitated using the tools available in the imaging instruments. Details of these methods are well known to one skilled in the art.

The degree of invasiveness into Matrigel or some other extracellular matrix constituent can be used as an assay to identify antibodies that are capable of inhibiting abnormal cell proliferation and tumor growth. Tumor cells exhibit a good correlation between malignancy and invasiveness of cells into Matrigel or some other extracellular matrix constituent. In this assay, tumorigenic cells are typically used as host cells. Therefore, antibodies can be identified by measuring changes in the level of invasiveness between the host cells before and after the introduction of potential modulators.

Briefly, the level of invasion of host cells can be measured by using filters coated with Matrigel or some other extracellular matrix constituent. Penetration into the gel, or through to the distal side of the filter, is rated as invasiveness, and rated histologically by number of cells and distance moved, or by prelabeling the cells with 125I and counting the radioactivity on the distal side of the filter or bottom of the dish. (see, e.g., Freshney, Culture of Animal Cells a Manual of Basic Technique, 3rd ed., Wiley-Liss, New York (1994), herein incorporated by reference).

b. Alteration of Gene Expression

Detection of binding and/or modulation of a target by an antibody can be accomplished by detecting a biological response, such as, for example, measuring $Ca^{2+}$ ion flux, cAMP, IP3, PIP3 or transcription of reporter genes. Analysis of the genotype of the cell (measurement of the expression of one or more of the genes of the cell using a reporter gene assay) after treatment is also used as an indicator of the efficacy or potency of the antibody. Hallmark genes, or those genes suspected to be associated with a signal transduction pathway are measured in both treated and untreated cells.

Assays can be performed that measure the activation of a reporter gene. Suitable reporter genes include endogenous genes as well as exogenous genes that are introduced into a cell by any of the standard methods familiar to the skilled artisan, such as transfection, electroporation, lipofection and viral infection. For example, cells expressing a recombinant receptor can be transfected with a reporter gene (e.g., chloramphenicol acetyltransferase, firefly luciferase, bacterial luciferase, β-galactosidase and alkaline phosphatase) operably linked to a response element. The cells are then incubated with antibodies and the expression of the reporter gene is compared to expression in control cells that do not express the recombinant receptor but that are essentially identical in other respects. A statistically significant change in reporter gene expression in the receptor-expressing cells is indicative of a test compound that interacts with the receptor. Furthermore, the protein of interest can be used as an indirect reporter via attachment to a second reporter such as red or green fluorescent protein (see, e.g., Mistili & Spector, (1997) *Nature Biotechnology* 15:961-964).

The reporter construct is typically transfected into a cell. After treatment with a potential modulator, the amount of reporter gene transcription, translation, or activity is measured according to standard techniques known to those of skill in the art. The use of a reporter gene assay using luciferase to measure activiation of STAT5 directly or by induction of cyclin-D promoter is exemplified in Example 12.

c. Cytotoxicity Activity

Antibodies can be screened for their ability to directly induce apoptosis or programmed cell death or to indirectly induce apoptosis by blocking growth factor receptors, thereby effectively arresting proliferation. Antibodies also bind complement, leading to direct cell toxicity, known as complement dependent cytotoxicity (CDC). Thus, assays can be performed to assess complement-dependent cytotoxicity.

A variety of assays to assess apoptosis are known to one of skill in the art. For example, apoptosis assays include those that assay for the activation of a caspase, which are enzymes involved in apoptosis. Caspase assays are based on the measurement of zymogen processing to an active enzyme and proteolytic activity. A number of commercial kits and reagents are available to assess apoptosis based on caspase function including, but not limited to, PhiPhiLux (OncoImmunin, Inc.), Caspase 3 activity assay (Roche Applied science), Homogenous Caspase assay (Roche Applied Science), Caspase-Glo Assays (Promega), Apo-ONE Homogeneous Caspase-3/7 Assay (Promega), CaspACE Assay System Colorimetric or Fluormetric (Promega), EnzChek Caspase-3 Assay Kit (Invitrogen), Imag-iT LIVE green Caspase-3 and 7 Detection Kit (Invitrogen), Active Caspase-3 Detection Kits (Stratagene), Caspase-mediated Apoptosis Products (BioVision) and CasPASE Apoptosis Assay Kit (Genotech).

Assays for apoptosis include TUNEL and DNA fragmentation assays that measure the activation of nucleases and subsequent cleavage of DNA into 180 to 200 base pair increments. Such assays and kits are commercially available and include, but are not limited to, Apoptotic DNA Ladder Kit (Roche Applied Science), Cellular DNA Fragmentation ELISA (Roche Applied Science), Cell Death Detection ELISAPLUS (Roche Applied Science), In Situ Cell Death Detection Kit (Roche Applied Science), DeadEnd Fluorometirc or Colorimetric TUNEL System (Promega), APO-BrdU TUNEL Assay Kit (Invitrogen), and TUNEL Apoptosis Detection Kit (Upstate).

Other assays to assess apoptosis include, for example, cell permeability assays that evaluate the loss of membrane integrity. For example, to determine whether the antibody is able to induce cell death, loss of membrane integrity as evaluated by uptake of propidium iodide (PI), trypan blue, or 7-aminoactinomycin D (7AAD) can be assessed relative to untreated cells. In addition, commercial kits such as APO-Percentage Assay (Biocolor Assays) can be used to measure apoptosis. Annexin V assays also can be employed. Annexin V binds to phosphatidylserine, which is normally found on the inner surface of the cytoplasmic membrane. During apoptosis, phosphatidylserine is translocated to the outer surface and can be detected by Annexin V. For example, standard binding assays using a fluorescent labeled Annexin V can be used (e.g. Annexin V, Alex Fluor 350 Conjugate from Invitrogen). Apoptosis also can be measured by assessing the presence of other markers of apoptosis, assessing protein cleavage, and/or by mitochondrial and ATP/ADP assays. Such assays are routine and known to one of skill in the art.

For example, apoptosis analysis can be used as an assay to identify functional antibodies using cell lines, such as RKO or HCT116, or other cells expressing a target protein of interest. The cells can be co-transfected with a construct containing a marker gene, such as a gene that encodes green fluorescent protein, or a cell tracker dye. The apoptotic change can be determined using methods known in the art, such as DAPI staining and TUNEL assay using fluorescent microscope. For TUNEL assay, commercially available kit can be used (e.g., Fluorescein FragEL DNA Fragmentation Detection Kit (Oncogene Research Products, Cat.# QIA39) and Tetramethyl-rhodamine-5-dUTP (Roche, Cat. #1534 378)). Cells contacted with an antibody exhibit, e.g., an increased apoptosis compared to control.

Cell death in vitro can be determined in the absence of complement and immune effector cells to distinguish cell death induced by antibody dependent cellular cytotoxicity (ADCC) or complement dependent cytotoxicity (CDC). Thus, the assay for cell death can be performed using heat inactivated serum (i.e. in the absence of complement) and in the absence of immune effector cells.

3. In Vivo Assays

Once an affinity matured antibody or converted antibody is generated by the methods herein, it can be assessed in vivo assays associated with aberrant activity of the target. In general, the method involves administering an antibody to a subject, generally a non-human animal model for a disease or condition and determining the effect of the antibody on the on the disease or condition of the model animal. In vivo assays include controls, where suitable controls include a sample in the absence of the antibody. Generally a plurality of assay mixtures is run in parallel with different antibody concentrations to obtain a differential response to the various concentrations. Typically, one of these concentrations serves as a negative control, i.e. at zero concentration or below the level of detection.

Non-human animals models include those induced to have a disease such as by injection with disease and/or phenotype-inducing substances prior to administration of the antibodies to monitor the effects on disease progression. Genetic models also are useful. Animals, such as mice, can be generated which mimic a disease or condition by the overexpression, underexpression or knock-out of one or more genes. Such animals can be generated by transgenic animal production techniques well-known in the art or using naturally-occurring or induced mutant strains. One of skill in the art is familiar with various animal models associated with particular targets.

Such animal model systems include, but are not limited to, mice, rats, rabbits, guinea pigs, sheep, goats, pigs, and non-human primates, e.g. baboons, chimpanzees and monkey. Any animal system well-known in the art can be used. Several aspects of the procedure can vary; said aspects include, but are not limited to, the temporal regime of administering the antibodies (e.g., prophylactic and/or therapeutic agents), whether such antibodies are administered separately or as an admixture, and the frequency of administration of the antibodies.

Recombinant (transgenic) animal models can be engineered by introducing the coding portion of the genes identified herein into the genome of animals of interest, using standard techniques for producing transgenic animals Animals that can serve as a target for transgenic manipulation include, without limitation, mice, rats, rabbits, guinea pigs, sheep, goats, pigs, and non-human primates, e.g. baboons, chimpanzees and monkeys. Techniques known in the art to introduce a transgene into such animals include pronucleic microinjection (U.S. Pat. No. 4,873,191); retrovirus-mediated gene transfer into germ lines (e.g., Van der Putten et al., (1985) *Proc. Natl. Acad. Sci. USA* 82:6148-615); gene targeting in embryonic stem cells (Thompson et al., (1989) *Cell* 56:313-321); electroporation of embryos (Lo, (1983) *Mol. Cel. Biol.* 3:1803-1814); sperm-mediated gene transfer (Lavitrano et al., (1989) *Cell* 57:717-73). For review, see, for example, U.S. Pat. No. 4,736,866.

Animal models can be used to assess the efficacy of an antibody, a composition, or a combination therapy provided herein. Examples of animal models for lung cancer include, but are not limited to, lung cancer animal models (see e.g. Zhang et al., (1994) *In Vivo* 8(5):755-69) and a transgenic mouse model with disrupted p53 function (see, e.g., Morris et al., (1998) *J La State Med Soc* 150(4):179-85). An example of an animal model for breast cancer includes, but is not limited to, a transgenic mouse that overexpresses cyclin D1 (see, e.g., Hosokawa et al., (2001) *Transgenic Res* 10(5):471-8). An example of an animal model for colon cancer includes, but is not limited to, a TCR b and p53 double knockout mouse (see, e.g., Kado et al., (2001), *Cancer Res* 61(6):2395-8). Examples of animal models for pancreatic cancer include, but are not limited to, a metastatic model of Panc02 murine pancreatic adenocarcinoma (see, e.g., Wang et al., (2001) *Int J Pancreatol* 29(1):37-46) and nu-nu mice generated in subcutaneous pancreatic tumors (see, e.g., Ghaneh et al., (2001) *Gene Ther* 8(3):199-208). Examples of animal models for non-Hodgkin's lymphoma include, but are not limited to, a severe combined immunodeficiency ("SCID") mouse (see, e.g., Bryant et al., (2000) *Lab Invest* 80(4):553-73) and an IgHmu-HOX11 transgenic mouse (see, e.g., Hough et al., (1998) *Proc Natl Acad Sci USA* 95(23):13853-8). An example of an animal model for esophageal cancer includes, but is not limited to, a mouse transgenic for the human papillomavirus type 16 E7 oncogene (see, e.g., Herber et al., (1996) *J Virol* 70(3):1873-81). Examples of animal models for colorectal carcinomas include, but are not limited to, Apc mouse models (see, e.g., Fodde & Smits, (2001) *Trends Mol Med* 7(8):369-73 and Kuraguchi et al., (2000) *Oncogene* 19(50):5755-63).

Animal models for arthritis include, but are not limited to, rheumatoid arthritis rats (see e.g. Pearson, (1956) *Proc. Soc. Exp. Biol. Med.,* 91:95-101) and collagen induced arthritis in mice and rats (see e.g. Current Protocols in Immunology, Eds. J. E. Cologan, A. M. Kruisbeek, D. H. Margulies, E. M. Shevach and W. Strober, John Wiley & Sons, Inc., 1994). An example of an animal model for asthma, includes but is not limited to, a mouse model of pulmonary hypersensitivity (see e.g. Riese et al. (1998) *J. Clin. Invest.* 101:2351-2363 and Shi, et al. (1999) *Immunity* 10:197-206) Animal models for allogenic rejection include, but are not limited to, rat allogeneic heart transplant models (see e.g. Tanabe et al. (1994) *Transplantation* 58:23-27 and Tinubu et al. (1994) *J. Immunol.* 153:4330-4338) and rat heterocardiac allograft rejection (Jae-Hyuck Sim et al. (2002) *Proc Natl Acad Sci U.S.A.* 99(16):10617-10622). Steel mice are used as a model of human aplastic anemia (see e.g. Jones, (1983) *Exp. Hematol.,* 11:571-580). An example of an animal model for anemia, includes but is not limited to, hemolytic anemia guinea pigs (see e.g. Schreiber, et al. (1972) *J. Clin. Invest.* 51:575). An example of an animal model for neutropenia, includes but is not limited to, neutropenia neutropenic CD rats (see, e.g. Nohynek et al. (1997) *Cancer Chemother. Pharmacol.* 39:259-266).

F. Methods of Production of Antibodies

Nucleic acid molecules and antibodies generated by the methods provided herein can be made by any method known to one of skill in the art. Such procedures are routine and are well known to the skill artisan. They include routine molecular biology techniques including gene synthesis, PCR, ligation, cloning, transfection and purification techniques. A description of such procedures is provided below.

For example, nucleic acid sequences can be constructed using gene synthesis techniques as discussed herein above. Gene synthesis or routine molecular biology techniques also can be used to effect insertion, deletion, addition or replacement of nucleotides. For example, additional nucleotide sequences can be joined to a nucleic acid sequence. In one example linker sequences can be added, such as sequences containing restriction endonuclease sites for the purpose of cloning the synthetic gene into a vector, for example, a protein expression vector or a vector designed for the amplification of the antibody constant region coding DNA sequences. Furthermore, additional nucleotide sequences specifying functional DNA elements can be operatively linked to a recombined germline encoding nucleic acid molecule. Examples of such sequences include, but are not limited to, promoter sequences designed to facilitate intracellular protein expression, and leader peptide sequences designed to facilitate protein secretion. Additional nucleotide sequences such as sequences specifying protein binding regions also can be linked to nucleic acid sequences. Such regions include, but are not limited to, sequences to facilitate uptake of recombined antibodies or fragments thereof into specific target cells, or otherwise enhance the pharmacokinetics of the synthetic gene.

Nucleic acid sequences can be further engineered as described herein, such as by mutagenesis, to generate mutant antibodies. Mutagenesis can be effected entirely through gene synthesis. For example, nucleic acid molecules can be designed manually or in silico for synthesis to encode mutant antibodies. The benefit of using gene synthesis methods is that the mutations can be effected so that the resulting nucleic acid molecules are in-frame and are "productive" as discussed herein above. Other methods of synthesis exist where randomization can be achieved during the gene synthesis. For example, a protocol has been developed by which synthesis of an oligonucleotide is "doped" with non-native phosphoramidites, resulting in randomization of the gene section targeted for random mutagenesis (Wang and Hoover (1997) *J. Bacteriol.,* 179:5812-9). This method allows control of position selection while retaining a random substitution rate. Alternatively, mutagenesis can be effected through other molecular biology techniques. Generally, site-directed mutagenesis strategies can be employed.

Other current methods can be used to create mutant antibodies include, but are not limited to, error-prone polymerase chain reaction (Caldwell and Joyce (1992); Gram et al. (1992) *Proc. Natl. Acad. Sci.,* 89:3576-80); cassette mutagenesis in which the specific region to be optimized is replaced with a synthetically mutagenized oligonucleotide (Stemmer and Morris (1992) *Biotechniques,* 13:214-20); Arkin and Youvan (1992) *Proc. Natl. Acad. Sci.,* 89:7811-7815; Oliphant et al. (1986) Gene, 44:177-83; Hermes et al. (1990) *Proc. Natl. Acad. Sci,* 87:696-700); the use of mutator strains of hosts cells to add mutational frequency (Greener et al. (1997) *Mol. Biotechnol.,* 7:189-95); DNA shuffling (Crameri et al. (1998) *Nature,* 391:288-291; U.S. Pat. Nos. 6,177,263; 5,965,408; Ostermeier et al. (1999) *Nat. Biotechnol.,* 17:1205-1209); and other random mutagenesis methods.

Antibodies provided herein can be generated or expressed as full-length antibodies or as antibodies that are less than full length, including, but not limited to Fabs, Fab hinge fragment, scFv fragment, scFv tandem fragment and scFv hinge and scFv hinge(ΔE) fragments. Various techniques have been developed for the production of antibody fragments. Traditionally, these fragments were derived via proteolytic digestion of intact antibodies (see e.g. Morimoto et al. (1992) *Journal of Biochemical and Biophysical Methods,* 24:107-117; Brennance et al. (1985) *Science,* 229:81). Fragments also can be produced directly by recombinant host cells. Fab, Fv and scFv antibody fragments can all be expressed in and secreted from host cells, such as *E. coli*, thus allowing the facile production of large amounts of these fragments. Also, Fab'-SH fragments can be chemically coupled to form F(ab')$_2$ fragments (Carter et al. (1992) *Bio/Technology,* 10:163-167). According to another approach, F(ab')$_2$ fragments can be isolated directly from recombinant host cell culture. In other examples, the antibody of choice is a single chain Fv fragment (scFv) (see e.g. WO93/16185; U.S. Pat. Nos. 5,571,894 and 5,587,458. Fv and sFv are the only species with intact combining sites that are devoid of constant regions; thus, they are suitable for reduced nonspecific binding during in vivo use. sFv fusion proteins can be constructed to yield fusion of an effector protein at either the amino or the carboxy terminus of an sFv. The antibody fragment can also be a linear antibody (see e.g. U.S. Pat. No. 5,641,870). Such linear antibody fragments can be monospecific or bispecific. Other techniques for the production of antibody fragments or antibody multimers are known to one of skill in the art.

For example, upon expression, antibody heavy and light chains pair by disulfide bond to form a full-length antibody or fragments thereof. For example, for expression of a full-length Ig, sequences encoding the $V_H$-$C_H1$-hinge-$C_H2$-$C_H3$ can be cloned into a first expression vector and sequences encoding the $V_L$-$C_L$ domains can be cloned into a second expression vector. Upon co-expression with the second expression vector encoding the $V_L$-$C_L$ domains, a full-length antibody is expressed. In another example, to generate a Fab, sequences encoding the $V_H$-$C_H1$ can be cloned into a first expression vector and sequences encoding the $V_L$-$C_L$ domains can be cloned into a second expression vector. The heavy chain pairs with a light chain and a Fab monomer is generated. In this example, exemplary vectors include Plasmids A, C, D and E as described elsewhere herein. Sequences of $C_H1$, hinge, $C_H2$ and/or $C_H3$ of various IgG sub-types are known to one of skill in the art (see e.g. U.S. Published Application No. 20080248028; see also SEQ ID NO: 2922). Similarly, sequences of CL, lambda or kappa, also is known (see e.g. U.S. Published Application No. 20080248028; see also SEQ ID NOS: 2923-2924).

1. Vectors

Provided herein are vectors for expression of nucleic acid encoding variable heavy chain or a variable light chain. The nucleic acids encoding antibody polypeptides are typically cloned into a intermediate vector before transformation into prokaryotic or eukaryotic cells. Choice of vector can depend on the desired application. For example, after insertion of the nucleic acid, the vectors typically are used to transform host cells, for example, to amplify the antibody genes for replication and/or expression thereof. In such examples, a vector suitable for high level expression is used. In other cases, a vector is chosen that is compatible with display of the expressed polypeptide on the surface of the cell.

The nucleic acids encoding antibody polypeptides are typically cloned into a vector before transformation into prokaryotic or eukaryotic cells. Choice of vector can depend on the desired application. For example, after insertion of the nucleic acid, the vectors typically are used to transform host cells, for example, to amplify the antibody genes for replication and/or expression thereof. In such examples, a vector suitable for high level expression is used. Expression can be in any cell expression system known to one of skill in the art. Exemplary cells for expression include, but are not limited to, 293FS cells, HEK293-6E cells or CHO cells. Other expression vectors and host cells are described below.

Generally, nucleic acid encoding the heavy chain of an antibody is cloned into a vector and the nucleic acid encoding the light chain of an antibody is cloned into the vector. The genes can be cloned into a single vector for dual expression thereof, or into separate vectors. If desired, the vectors also can contain further sequences encoding additional constant region(s) or hinge regions to generate other antibody forms.

Many expression vectors are available and known to those of skill in the art for the expression of antibodies or portions thereof. The choice of an expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells. Vectors also generally can contain additional nucleotide sequences operably linked to the ligated nucleic acid molecule (e.g. His tag, Flag tag). For purposes herein, vectors generally include sequences encoding the constant region. Thus, recombined antibodies or portions thereof also can be expressed as protein fusions. For example, a fusion can be generated to add additional functionality to a polypeptide. Examples of fusion proteins include, but are not limited to, fusions of a signal sequence, an epitope tag such as for localization, e.g. a $his_6$ tag or a myc tag, or a tag for purification, for example, a GST fusion, and a sequence for directing protein secretion and/or membrane association.

For example, expression of the proteins can be controlled by any promoter/enhancer known in the art. Suitable bacterial promoters are well known in the art and described herein below. Other suitable promoters for mammalian cells, yeast cells and insect cells are well known in the art and some are exemplified below. Selection of the promoter used to direct expression of a heterologous nucleic acid depends on the particular application. Promoters which can be used include but are not limited to eukaryotic expression vectors containing the SV40 early promoter (Bernoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Brinster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242: 79-94 (1980)); plant expression vectors containing the nopaline synthetase promoter (Herrara-Estrella et al., *Nature* 303:209-213 (1984)) or the cauliflower mosaic virus 35S RNA promoter (Gardner et al., *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals:

elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature* 315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinckert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 (1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In addition to the promoter, the expression vector typically contains a transcription unit or expression cassette that contains all the additional elements required for the expression of the antibody, or portion thereof, in host cells. A typical expression cassette contains a promoter operably linked to the nucleic acid sequence encoding the germline antibody chain and signals required for efficient polyadenylation of the transcript, ribosome binding sites and translation termination. Additional elements of the cassette can include enhancers. In addition, the cassette typically contains a transcription termination region downstream of the structural gene to provide for efficient termination. The termination region can be obtained from the same gene as the promoter sequence or can be obtained from different genes.

Some expression systems have markers that provide gene amplification such as thymidine kinase and dihydrofolate reductase. Alternatively, high yield expression systems not involving gene amplification are also suitable, such as using a baculovirus vector in insect cells, with a nucleic acid sequence encoding a germline antibody chain under the direction of the polyhedron promoter or other strong baculovirus promoter.

Exemplary expression vectors include any mammalian expression vector such as, for example, pCMV. For bacterial expression, such vectors include pBR322, pUC, pSKF, pET23D, and fusion vectors such as MBP, GST and LacZ. Exemplary of such a vector are bacterial expression vectors such as, for example, plasmid A, plasmid C, plasmid D and plasmid E, described herein. Other eukaryotic vectors, for example any containing regulatory elements from eukaryotic viruses can be used as eukaryotic expression vectors. These include, for example, SV40 vectors, papilloma virus vectors, and vectors derived from Epstein-Bar virus. Other exemplary eukaryotic vectors include pMSG, pAV009/A+, pMT010/A+, pMAMneo-5, baculovirus pDSCE, and any other vector allowing expression of proteins under the direction of the CMV promoter, SV40 early promoter, SV40 late promoter, metallothionein promoter, murine mammary tumor virus promoter, Rous sarcoma virus promoter, polyhedron promoter, or other promoters shown effective for expression in eukaryotes.

Vectors can be provided that contain a sequence of nucleotides that encodes a constant region of an antibody operably linked to the nucleic acid sequence encoding the variable region of the antibody. The vector can include the sequence for one or all of a CH1, CH2, CH3 or CH4 and/or CL. Generally, such as for expression of Fabs, the vector contains the sequence for a CH1 or CL. In one example, nucleic acid encoding the heavy chain of an antibody, is ligated into a first expression vector and nucleic acid encoding the light chain of an antibody, is ligated into a second expression vector. The expression vectors can be the same or different, although generally they are sufficiently compatible to allow comparable expression of proteins (heavy and light chain) therefrom. The first and second expression vectors are generally co-transfected into host cells, typically at a 1:1 ratio. Exemplary of vectors include, but are not limited to, pγ1HC and pκLC (Tiller et al. (2008) *J Immunol. Methods,* 329:112-24). Other expression vectors include the light chain expression vector pAG4622 and the heavy chain expression vector pAH4604 (Coloma et al. (1992) *J Immunol. Methods,* 152:89-104). The pAG4622 vector contains the genomic sequence encoding the C-region domain of the human κL chain and the gpt selectable marker. The pAH4604 vectors contain the hisD selectable marker and sequences encoding the human H chain γ1 C-region domain. In another example, the heavy and light chain can be cloned into a single vector that has expression cassettes for both the heavy and light chain. Other exemplary expression vectors include Plasmids A, C, D and E, described elsewhere herein.

For purposes herein, vectors are provided that contain a sequence of nucleotides that encodes a constant region of an antibody operably linked to the nucleic acid sequence encoding the recombined variable region of the antibody. The vector can include the sequence for one or all of a CH1, CH2, hinge, CH3 or CH4 and/or CL. Generally, such as for expression of Fabs, the vector contains the sequence for a CH1 (amino acids 1-103 of SEQ ID NO:2922) or CL (for kappa light chains, see SEQ ID NO:2923; for lambda light chains, see SEQ ID NO:2924). The sequences of constant regions or hinge regions are known to one of skill in the art (see e.g. U.S. Published Application No. 20080248028 and SEQ ID NOS:2922-2924, including CH1 (amino acids 1-103 of SEQ ID NO:2922), IgG1 hinge region (amino acids 104-119 of SEQ ID NO:2922), IgG1 CH2 (amino acids 120-223 of SEQ ID NO:2922), IgG1 CH3 (amino acids 224-330 of SEQ ID NO:2922), CL kappa (SEQ ID NO:2923) and CL lambda (SEQ ID NO:2924). Exemplary of such vectors containing a heavy chain constant region gene (e.g. CH1) are plasmids A and D, described herein. Exemplary of such vectors containing a light chain constant region genes are plasmids C and E, described herein.

Exemplary plasmid vectors for transformation of *E. coli* cells, include, for example, the ColE1 replication vectors described herein. Several features common to all these vectors include (a) a pBAD inducible promoter; (b) an AraC gene, which controls the pBAD promoter; (c) a synthetic ribosomal binding site (RBS) for efficient translation; (d) a ColE1 origin of replication, allowing for high copy expression; (e) a STII leader sequence, allowing for expressed proteins to be translocated to the periplasm; (f) a f1 origin of replication; and (g) a gene for conferring antibiotic resistance. Such plasmids include plasmid A (SEQ ID NO:84), plasmid C (SEQ ID NO:86), plasmid D (SEQ ID NO:85)

and plasmid E (SEQ ID NO:87). Plasmid A and Plasmid D are utilized for expression of heavy chain antibody genes in as they contain a gene for the heavy chain constant region (CH1) operably linked to the inserted gene for the heavy chain variable region. The vectors contain NheI and NcoI restriction sites to allow for cloning of the recombined antibody genes described herein. Both vectors contain a pUC origin of replication, a ColE1 type origin of replication, and an aminoglycoside phosphotransferase gene conferring kanamycin resistance. Plasmid A contains a $(His)_6$ Tag and a Flag Tag for protein purification. Plasmid D contains both a $(His)_6$ Tag and a Flag Tag, and an additional LPETG tag, which allows for covalent attachment of the resulting protein using a sortase. Plasmid C and Plasmid E are utilized for expression of light chain antibody genes in as they contain a gene for the light chain constant region (CL) operably linked to the inserted gene for the light chain variable region. Plasmid C is specific for kappa light chains and contains BseWI and NcoI restriction sites to allow for cloning of the recombined antibody genes described herein. Plasmid E is specific for lambda light chains and contains AcrII and NcoI restriction sites to allow for cloning of the recombined antibody genes described herein. Both vectors contain a 3.3 origin of replication, a ColE1 type origin of replication, and a gene conferring chloramphenicol resistance. The vectors described above are designed to be utilized in a dual vector system, in which a light chain vector and a heavy chain vector are co-transformed. Thus, they contain two different but compatible ColE1 origins of replication utilized, one for heavy chains and one light chain. This allows for efficient expression of both chains of the antibody when the vectors are co-transformed and expressed.

Any methods known to those of skill in the art for the insertion of DNA fragments into a vector can be used to construct expression vectors containing a nucleic acid encoding an antibody chain. These methods can include in vitro recombinant DNA and synthetic techniques and in vivo recombinants (genetic recombination). The insertion into a cloning vector can, for example, be accomplished by ligating the DNA fragment into a cloning vector which has complementary cohesive termini. If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized nucleic acids encoding restriction endonuclease recognition sequences.

2. Cells and Expression Systems

Cells containing the vectors also are provided. Generally, any cell type that can be engineered to express heterologous DNA and has a secretory pathway is suitable. Expression hosts include prokaryotic and eukaryotic organisms such as bacterial cells (e.g. *E. coli*), yeast cells, fungal cells, Archea, plant cells, insect cells and animal cells including human cells. Expression hosts can differ in their protein production levels as well as the types of post-translational modifications that are present on the expressed proteins. Further, the choice of expression host is often related to the choice of vector and transcription and translation elements used. For example, the choice of expression host is often, but not always, dependent on the choice of precursor sequence utilized. For example, many heterologous signal sequences can only be expressed in a host cell of the same species (i.e., an insect cell signal sequence is optimally expressed in an insect cell). In contrast, other signal sequences can be used in heterologous hosts such as, for example, the human serum albumin (hHSA) signal sequence which works well in yeast, insect, or mammalian host cells and the tissue plasminogen activator pre/pro sequence which has been demonstrated to be functional in insect and mammalian cells (Tan et al., (2002) *Protein Eng.* 15:337). The choice of expression host can be made based on these and other factors, such as regulatory and safety considerations, production costs and the need and methods for purification. Thus, the vector system must be compatible with the host cell used.

Expression in eukaryotic hosts can include expression in yeasts such as *Saccharomyces cerevisiae* and *Pichia pastoris*, insect cells such as *Drosophila* cells and lepidopteran cells, plants and plant cells such as tobacco, corn, rice, algae, and *lemna*. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs.

Recombinant molecules can be introduced into host cells via, for example, transformation, transfection, infection, electroporation and sonoporation, so that many copies of the gene sequence are generated. Generally, standard transfection methods are used to produce bacterial, mammalian, yeast, or insect cell lines that express large quantity of antibody chains, which is then purified using standard techniques (see e.g., Colley et al. (1989) J. Biol. Chem., 264: 17619-17622; Guide to Protein Purification, in Methods in Enzymology, vol. 182 (Deutscher, ed.), 1990). Transformation of eukaryotic and prokaryotic cells are performed according to standard techniques (see, e.g., Morrison (1977) J. Bact. 132:349-351; Clark-Curtiss and Curtiss (1983) Methods in Enzymology, 101, 347-362). For example, any of the well-known procedures for introducing foreign nucleotide sequences into host cells can be used. These include the use of calcium phosphate transfection, polybrene, protoplast fusion, electroporation, biolistics, liposomes, microinjection, plasma vectors, viral vectors and any other the other well known methods for introducing cloned genomic DNA, cDNA, synthetic DNA or other foreign genetic material into a host cell. Generally, for purposes herein, host cells are transfected with a first vector encoding at least a VH chain and a second vector encoding at least a VL chain. Thus, it is only necessary that the particular genetic engineering procedure used be capable of successfully introducing at least both genes into the host cell capable of expressing germline, or modified form thereof, antibody polypeptide.

Transformation of host cells with recombinant DNA molecules that incorporate the isolated recombined variable region gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA. Generally, After the expression vector is introduced into the cells, the transfected cells are cultured under conditions favoring expression of the germline chain, which is recovered from the culture using standard purification techniques identified below.

Antibodies and portions thereof can be produced using a high throughput approach by any methods known in the art for protein production including in vitro and in vivo methods such as, for example, the introduction of nucleic acid molecules encoding antibodies or portions thereof into a host cell or host animal and expression from nucleic acid molecules encoding antibodies in vitro. Prokaryotes, especially *E. coli*, provide a system for producing large amounts of antibodies or portions thereof, and are particularly desired in applications of high-throughput expression and purification of proteins. Transformation of *E. coli* is a simple and rapid technique well known to those of skill in the art. *E. coli* host strains for high throughput expression include, but are not limited to, BL21 (EMD Biosciences) and LMG194 (ATCC). Exemplary of such an *E. coli* host strain is BL21. Vectors for high throughput expression include, but are not limited to, pBR322 and pUC vectors. Exemplary of such vectors are the vectors described herein, including plasmid A, plasmid C, plasmid D and plasmid E. Automation of expression and purification can facilitate high-throughput expression. For example, use of a Piccolo™ system (Wollerton et al. (2006) JALA, 11:291-303), a fully automatic system that combines cell culture with automated harvesting, lysing and purification units, or other similar robotic system can be employed.

a. Prokaryotic Expression

Prokaryotes, especially *E. coli*, provide a system for producing large amounts of antibodies or portions thereof. Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $\lambda P_L$ promoter.

Antibodies or portions thereof can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An exemplary alternative approach is the expression of antibodies or fragments thereof in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. There are three major pathways to translocate expressed proteins into the periplasm, namely the Sec pathway, the SRP pathway and the TAT pathway. Examples of periplasmic-targeting leader sequences include the pelB leader from the pectate lyase gene, the StII leader sequence, and the DsbA leader sequence. An exemplary leader sequence is a DsbA leader sequence. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisiae, Schizosaccharomyces pombe, Yarrowia Kluyveromyces lactis*, and *Pichia pastoris* are useful expression hosts for recombined antibodies or portions thereof. Yeast can be transformed with episomal replicating vectors or by stable chromosomal integration by homologous recombination. Typically, inducible promoters are used to regulate gene expression. Examples of such promoters include AOX1, GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the Arxula adeninivorans glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects

Insect cells, particularly using baculovirus expression, are useful for expressing antibodies or portions thereof. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter and p10 promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda* and TN derived from *Trichoplusia ni*. For high-level expression, the nucleotide sequence of the molecule to be expressed is fused immediately downstream of the polyhedrin initiation codon of the virus. To generate baculovirus recombinants capable of expressing human antibodies, a dual-expression transfer, such as pAcUW51 (PharMingen) is utilized. Mammalian secretion signals are accurately processed in insect cells and can be used to secrete the expressed protein into the culture medium An alternative expression system in insect cells is the use of stably transformed cells. Cell lines such as Sf9 derived cells from *Spodoptera frugiperda* and TN derived cells from *Trichoplusia ni* can be used for expression. The baculovirus immediate early gene promoter IE1 can be used to induce consistent levels of expression. Typical expression vectors include the pIE1-3 and pI31-4 transfer vectors (Novagen). Expression vectors are typically maintained by the use of selectable markers such as neomycin and hygromycin.

d. Mammalian Cells

Mammalian expression systems can be used to express antibodies or portions thereof. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Antibodies are typically produced using a NEO®/G418 system, a dihydrofolate reductase (DHFR) system or a glutamine synthetase (GS) system. The GS system uses joint expression vectors, such as pEE12/pEE6, to express both heavy chain and light chain. Fusion with cell surface signaling molecules such as TCR-ζ and Fc$_e$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42.)

e. Plants

Transgenic plant cells and plants can be used to express proteins such as any antibody or portion thereof described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus CaMV 35S promoter, the nopaline synthase promoter, the ribose bisphosphate carboxylase promoter and the maize ubiquitin-1 (ubi-1) promoter promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteases or modified proteases (see for example, Mayfield et al. (2003) *PNAS* 100:438-442). Because plants have different glycosylation patterns than mammalian cells, this can influence the choice of protein produced in these hosts.

3. Purification

Antibodies and portions thereof are purified by any procedure known to one of skill in the art. The antibodies generated or used by the methods herein can be purified to substantial purity using standard protein purification techniques known in the art including but not limited to, SDS-PAGE, size fraction and size exclusion chromatography, ammonium sulfate precipitation, chelate chromatography, ionic exchange chromatography or column chromatography. For example, antibodies can be purified by column chromatography. Exemplary of a method to purify antibodies is by using column chromatography, wherein a solid support column material is linked to Protein G, a cell surface-associated protein from *Streptococcus*, that binds immunoglobulins with high affinity. The antibodies can be purified to 60%, 70%, 80% purity and typically at least 90%, 91%, 92%, 93%, 94%, 95%, 96%, 97%, 98% or 99% purity. Purity can be assessed by standard methods such as by SDS-PAGE and coomassie staining Methods for purification of antibodies or portions thereof from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

When antibodies are expressed by transformed bacteria in large amounts, typically after promoter induction, although expression can be constitutive, the polypeptides can form insoluble aggregates. There are several protocols that are suitable for purification of polypeptide inclusion bodies known to one of skill in the art. Numerous variations will be apparent to those of skill in the art.

For example, in one method, the cell suspension is generally centrifuged and the pellet containing the inclusion bodies resuspended in buffer which does not dissolve but washes the inclusion bodies, e.g., 20 mM Tris-HCL (pH 7.2), 1 mM EDTA, 150 mM NaCl and 2% Triton-X 100, a non-ionic detergent. It can be necessary to repeat the wash step to remove as much cellular debris as possible. The remaining pellet of inclusion bodies can be resuspended in an appropriate buffer (e.g., 20 mM sodium phosphate, pH 6.8, 150 mM NaCl). Other appropriate buffers are apparent to those of skill in the art.

Alternatively, antibodies can be purified from bacteria periplasm. Where the polypeptide is exported into the periplasm of the bacteria, the periplasmic fraction of the bacteria can be isolated by cold osmotic shock in addition to other methods known to those of skill in the art. For example, in one method, to isolate recombinant polypeptides from the periplasm, the bacterial cells are centrifuged to form a pellet. The pellet is resuspended in a buffer containing 20% sucrose. To lyse the cells, the bacteria are centrifuged and the pellet is resuspended in ice-cold 5 mM MgSO$_4$ and kept in an ice bath for approximately 10 minutes. The cell suspension is centrifuged and the supernatant decanted and saved. The recombinant polypeptides present in the supernatant can be separated from the host proteins by standard separation techniques well known to those of skill in the art. These methods include, but are not limited to, the following steps: solubility fractionation, size differential filtration, and column chromatography.

G. Anti-DLL4 Activator/Modulator Antibodies and Uses Thereof

Provided herein are anti-DLL4 multimer antibodies that specifically bind to human Delta-like ligand 4 (DLL4) DLL4 and that are activator/modulators of DLL4 activity. Thus, the multimer antibodies can be used as antiangiogenic therapeutics to treat diseases or disorders characterized by excessive or aberrant angiogenesis, such as for example, cancer or macular degeneration.

1. DLL4 a. Structure

DLL4 (set forth in SEQ ID NO:2904; and encoded by a sequence of nucleotides set forth in SEQ ID NO:2905) is a transmembrane protein ligand for Notch transmembrane receptors. The extracellular region contains 8 EGF-like repeats, as well as a DSL domain that is conserved among all Notch ligands and is necessary for receptor binding. The protein also contains a transmembrane region, and a cytoplasmic tail lacking any catalytic motifs. Human DLL4 is a 685 amino acid protein and contains the following domains corresponding to amino acids set forth in SEQ ID NO:2904: signal peptide (amino acids 1-25); MNNL (amino acids 26-92); DSL (amino acids 155-217); EGF-Like 1 (EGF1; amino acids 221-251); EGF-Like 2 (EGF2; amino acids 252-282); EGF-Like 3 (EGF3; amino acids 284-322); EGF-Like 4 (EGF4; amino acids 324-360); EGF-Like 5 (EGF5; amino acids 366-400); EGF-Like 6 (EGF6; amino acids 402-438); EGF-Like 7 (EGF7; amino acids 440-476); EGF-Like 8 (EGF8; amino acids 480-518); transmembrane (amino acids 529-551); and cytoplasmic domain (amino acids 553-685).

b. Expression

DLL4 is expressed widely in a variety of tissues, but its expression is predominantly localized to the vasculature. It is required for normal vascular development and is expressed on tumor vessels. It is upregulated in blood vessels during tumor angiogenesis and expression is dependent on VEGF signaling. DLL4 also is expressed on activated macrophages exposed to proinflammatory stimuli such as lipopolysaccharide, interleukin-1β, Toll-like receptor 4 ligands and other proinflammatory stimuli and it's signaling through the Notch pathway plays a role in inflammatory states characterized by macrophage activation (Fung et al. (2007) *Circulation*, 115: 2948-2956).

c. Function

DLL4 binds to Notch receptors. The evolutionary conserved Notch pathway is a key regulator of many developmental processes as well as postnatal self-renewing organ systems. From invertebrates to mammals, Notch signaling guides cells through a myriad of cell fate decisions and inclueneces proliferation, differentiation and apoptosis (Miele and Osborne (1999) *J Cell Physiol.*, 181:393-409). The Notch family is made up of structurally conserved cell surface receptors that are activated by membrane bound ligands of the DSL gene family (named for Delta and Serrate from *Drosophila* and Lag-2 from *C. elegans*). Mammals have four receptors (Notch 1, Notch 2, Notch 3 and Notch 4) and five ligands (Jag 1, Jag 2, DLL1, DLL3, and DLL4). Upon activation by ligands presented on neighboring cells, Notch receptors undergo successive proteolytic cleavages; an extracellular cleavage mediated by an ADAM protease and a cleavage within the trnamembrane domain mediated by gamma secretase. This leads to the release of the Notch Intra-Cellular Domain (NICD), which translocates into the nucleus and forms a transcriptional complex with the DNA binding protein, RBP-Jk (also known as CSL for CBF1/Su (H)/Lag-1) and other transcriptional cofactors. The primary target genes of Notch activation include the HES (Hairy/Enhance of Split) gene family and HES-related genes (Hey, CHF, HRT, HESR), which in turn regulate the downstream transcriptional effectors in a tissue and cell-type specific manner (Iso et al. (2003) *J Cell Physiol.*, 194:237-255; Li and Harris (2005) *Cancer Cell*, 8:1-3).

Signaling by Notch receptors implicate a variety of cellular processes including, but not limited to, the normal maintenance and leukemic transformation of hematopoietic stem cells (HSCs; Kopper & Hajdu (2004) *Pathol. Oncol. Res.*, 10:69-73); maintenance of neural stem cells including in their normal maintenance as well as in brain cancers (Kopper & Hajdu (2004) *Pathol. Oncol. Res.*, 10:69-73; Purow et al. (2005) *Cancer Res.* 65:2353-63; Hallahan et al., (2004) *Cancer Res.* 64:7794-800); generation of a number of human cancers including in lymphoblastic leukemia/lymphoma (Ellisen et al. (1991) *Cell*, 66:649-61; Robey et al. (1996) *Cell*, 87:483-92; Pear et al. (1996) *J. Exp. Med.* 183:2283-91; Yan et al. (2001) *Blood* 98:3793-9; Bellavia et al. (2000) *EMBO J.* 19:3337-48; Pear & Aster (2004) *Curr. Opin. Hematol.*, 11:416-33); breast cancer (Gallahan & Callahan (1987) *J. Virol.*, 61:66-74; Brennan & Brown (2003) *Breast Cancer Res.*, 5:69; Politi et al. (2004) *Semin. Cancer Biol.*, 14:341-7; Weijzen et al. (2002) *Nat. Med.*, 8:979-86; Parr et al. (2004) *Int. J. Mol. Med.*, 14:779-86); cervical cancer (Zagouras et al. (1995) *PNAS*, 92:6414-8); renal cell carcinomas (Rae et al (2000) *Int. J. Cancer*, 88:726-32); head and neck squamous cell carcinomas (Leethanakul et al (2000) *Oncogene*, 19:3220-4); endometrial cancers (Suzuki et al. (2000) *Int. J. Oncol.*, 17:1131-9); and neuroblastomas (van Limpt et al. (2000) *Med. Pediatr. Oncol.*, 35:554-8). The Notch pathway also is involved in multiple aspects of vascular development including proliferation, migration, smooth muscle differentiation, angiogenesis and arterial-venous differentiation (Iso et al. (2003) *Arterioscler. Thromb. Vasc. Biol.* 23: 543).

The Notch ligand DLL4, which interacts with Notch-1 (Uniprot accession No. P46531; SEQ ID NO:2906) and Notch-4 receptors (Uniprot accession No. Q99466; SEQ ID NO:2907), is expressed predominantly in the vasculature. Studies assessing the effects of overexpression of DLL4 have shown that DLL4 is a negative regulator of angiogenesis, endothelial cell proliferation, migration and vessel branching (see e.g. Trindade et al. (2008) Blood 1:112). One explanation for the antiangiogenic activity of DLL4 is that it is a VEGF responsive gene and acts as a negative regulator of VEGF signaling, which is a proangiogenic factor. Thus, targeting the activation of DLL4 promotes the antiangiogenic activity of DLL4.

In contrast, blocking DLL4 is associated with nonproductive angiogensis. Although DLL4 increases angiogenesis characterized by sprouting and branching of blood vessels, it also is associated with a decrease in vessel function, thereby resulting in decreased tumor growth (Ridgway et al. (2006) *Nature*, 444:1083; Noguera-Troise et al. (2006) *Nature*, 444:1032). Accordingly, DLL4 function is associated with deregulated angiogenesis by uncoupling of tumor growth from tumor vascular density. Thus, blocking DLL4 signaling effectively reduces tumor growth by disrupting productive angiogenesis. Accordingly, targeting the inhibition of DLL4 also can be used to treat tumors undergoing angiogenesis (see e.g. International PCT application No. WO2009/085209).

2. Activator/Modulator Anti-DLL4 Multimer Antibodies

Provided herein are antibodies or antibody fragments thereof that are activator/modulators of DLL4 activity. The antibodies activate or increase the activity of DLL4, and thereby act as anti-angiogenic agents. For example, the antibody multimers provided herein increase the activity of DLL4-mediated receptor activation, for example activation of DLL4-mediated Notch-1 or Notch-4 signaling, compared to activation in the absence of the antibody multimer. DLL4-mediated activity is increased at least 1.1-fold, for example, between or about 1.2-fold to 5-fold, such as 1.1-fold, 1.2-, 1.3-, 1.4-, 1.5-, 1.6-, 1.7-, 1.8-, 1.9-, 2.0-, 2.5-, 3.0-, 3.5-, 4.0-, 4.5-, 5-fold or more in the presence of the antibody multimer compared to activation in its absence. Thus, the antibodies can be used to treat angiogenic diseases or disorders. In some examples, the antibodies provided herein are agonists. In other examples, the antibodies provided herein are activator/modulators of DLL4 by activating Notch signaling.

The antibody multimers provided herein exhibit rapid on/off kinetics for their binding site on DLL4. In particular, the antibody exhibits a fast $k_{off}$. For example, when assessed as a monomeric Ig fragment, antibodies provided herein have a $k_{off}$ that is or is about between 1 $s^{-1}$ to $5\times10^{-2}$ $s^{-1}$, for example, 0.5 $s^{-1}$ to 0.01 $s^{-1}$, such as for example, at or about 0.1 $s^{-1}$. For example, the $k_{off}$ of antibodies provided herein, when assessed in Fab form, is at or about $5\times10^{-2}$ $s^{-1}$, $4\times10^{-2}$ $s^{-1}$, $3\times10^{-2}$ $s^{-1}$, $2\times10^{-2}$ $s^{-1}$, $1\times10^{-2}$ $s^{-1}$, 0.02 $s^{-1}$, 0.03 $s^{-1}$, 0.04 $s^{-1}$, 0.05 $s^{-1}$, 0.06 $s^{-1}$, 0.07 $s^{-1}$, 0.08 $s^{-1}$, 0.09 $s^{-1}$, 0.1 $s^{-1}$, 0.2 $s^{-1}$, 0.3 $s^{-1}$, 0.4 $s^{-1}$, 0.5 $s^{-1}$, 0.6 $s^{-1}$, 0.7 $s^{-1}$, 0.8 $s^{-1}$, 0.9 $s^{-1}$, 1 $s^{-1}$ or faster, so long as the antibody multimer specifically binds to DLL4. In some examples, the antibodies provided herein exhibit a dissociation half-life ($t_{1/2}$), when assessed as a monomeric Ig fragment, that is between 0.5 seconds (s) to 150 s, for example, 1 s to 100 s, 5 s to 50 s or 5 s to 10 s. For example, the $t_{1/2}$ of antibodies provided herein, when assessed as a monomeric Ig fragment, is or is about 1 s, 2 s, 3 s, 4 s, 5 s, 6 s, 7 s, 8 s, 9 s, 10 s, 20 s, 30 s, 40 s, 50 s, 60 s, 70 s, 80 s, 90 s, 100 s, 110 s, 120 s, 130 s, 140 s or 150 s. Methods to determine kinetic rate constants of antibodies are known to one of skill in the art. For example, surface plasmon resonance using Biacore™ instrument can be used (BiaCore Life Science; GE Healthcare). Services offering Biacore instrumentation and other instrumentations are available (Biosensor Tools; Salt Lake City, Utah; biosensortools.com/index.php).

Typically, antibody multimers provided herein exhibit a generally low binding affinity. For example, when assessed as a monomeric Ig fragment, antibodies provided herein exhibit a binding affinity that is $10^{-8}$ M or lower binding affinity. For example, the binding affinity is between $10^{-6}$ M to $10^{-8}$ M, such as between $4\times10^{-6}$ M to $10^{-8}$ M, for example between $1\times10^{-7}$ M to $10^{-8}$ M. For example, the binding affinity of antibodies provided herein, as a monomeric Ig fragment, is at or about $1\times10^{-6}$ M, $2\times10^{-6}$ M, $3\times10^{-6}$ M, $4\times10^{-6}$ M, $5\times10^{-6}$ M, $6\times10^{-6}$ M, $7\times10^{-6}$ M, $8\times10^{-6}$ M, $9\times10^{-6}$ M, $1\times10^{-7}$ M, $2\times10^{-7}$ M, $3\times10^{-7}$ M, $4\times10^{-7}$ M, $5\times10^{-7}$ M, $6\times10^{-7}$ M, $7\times10^{-7}$ M, $8\times10^{-7}$ M, $9\times10^{-7}$ M or $1\times10^{-8}$ M. Methods to assess binding affinity are known to one of skill in the art and are described elsewhere herein in Section E.

The antibodies provided herein are multimers, such that they contain at least two antigen-binding sites. Generally, the antibodies provided herein contain at least two variable heavy chain, or a sufficient portion thereof to bind antigen; and two variable light chains, or a sufficient portion thereof to bind antigen that are associated by a multimerization domain. The multimers can be dimers, trimers or higher-order multimers of monomeric immunoglobulin molecules. The multimers include those that are bivalent, trivalent, tetravalent, pentavalent, hexavalent, heptavalent, or greater valency (i.e., containing 2, 3, 4, 5, 6, 7 or more antigen-binding sites). For example, dimers of whole immunoglobulin molecules or of F(ab')2 fragments are tetravalent, whereas dimers of Fab fragments or scFv molecules are bivalent.

Individual antibodies within a multimer can have the same or different binding specificites. Typically, the multimers are monospecific, containing two or more antigen-binding domains that immunospecifically bind to the same epitope on DLL4. In some examples, antibody multimers can be generated that are multispecific, containing two or more antigen-binding domains that immunospecifically bind to two of more different epitopes. The epitopes can be DLL4 epitopes. In some examples, the antibody multimers bind an epitope in DLL4 and also bind an epitope in another different target antigen.

Techniques for engineering antibody multimers are known in the art, and include, for example, linkage of two or more variable heavy chains and variable light chains via covalent, non-covalent, or chemical linkage. Multimerization of antibodies can be accomplished through natural aggregation of antibodies or through chemical or recombinant linking techniques known in the art. Thus, multimerization between two antibody polypeptide chains or antigen-binding fragments can be spontaneous, or can occur due to forced linkage of two or more polypeptides. In one example, antibody multimers can be generated by disulfide bonds formed between cysteine residues on different polypeptide chains. In another example, antibody multimers are generated by joining polypeptides via covalent or non-covalent interactions. In some examples, multimers can be generated form peptides such as peptide linkers (spacers), or peptides that have the property of promoting multimerization. In some examples, antibody multimers can be formed through chemical linkage, such as for example, by using heterobifunctional linkers.

For example, antibody multimers include antibodies that contain a light chain containing a VL-CL and a heavy chain containing a VH-CH1-hinge and a sufficient portion of CH2-CH3 (or CH4 if of an IgE or IgM class) to permit association of heavy chains. Upon purification, such antibodies (e.g. full length IgG1) spontaneously form aggregates containing antibody homodimers, and other higher-order antibody multimers. Exemplary of a constant region can include a constant region portion of an immunoglobulin molecule, such as from IgG1, IgG2, IgG3, IgG4, IgA, IgD, IgM, and IgE. Sequences of antibody regions are known and can be used to recombinantly generate antibody multimers (see e.g. US20080248028). For example, a light chain amino acid sequence can include the CL domain, kappa (set forth in SEQ ID NO:2923) or lambda (SEQ ID NO:2924). A heavy chain amino acid sequence can include one or more of a CH1, hinge, CH2, CH3 or CH4 from an IgG1 (SEQ ID NO:2922), IgG2 (SEQ ID NO: 2937), IgG3 (SEQ ID NO:2925), IgA (SEQ ID NO:2926 or 2927) or IgM (SEQ ID NO:2928 or 2929) subclass. In particular, antibody multimers provided herein are full-length antibodies that contain a light chain containing a VL-CL and a heavy chain containing a VH-CH1-hinge-CH2-CH3. For example, in such an antibody multimer, the resulting antibody molecule is at least a four chain molecule where each heavy chain is linked to a light chain by a disulfide bond, and the two heavy chains are linked to each other by disulfide bonds. Linkage of the heavy chains also is mediated by a flexible region of the heavy chain, known as the hinge region.

Alternatively, antibody homodimers can be formed through chemical linkage techniques known in the art. For example, heterobifunctional crosslinking agents, including, but not limited to, SMCC [succinimidyl 4-(maleimidomethyl)cyclohexane-1-carboxylate] and SATA [N-succinimidyl S-acethylthio-acetate] (available, for example, from Pierce Biotechnology, Inc. (Rockford, Ill.)) can be used to form antibody multimers. An exemplary protocol for the formation of antibody homodimers is given in Ghetie et al., *Proceedings of the National Academy of Sciences USA* (1997) 94:7509-7514. Antibody homodimers can be converted to Fab'2 homodimers through digestion with pepsin. Another way to form antibody homodimers is through the use of the autophilic T15 peptide described in Zhao and Kohler, *The Journal of Immunology* (2002) 25:396-404.

ScFv dimers can also be formed through recombinant techniques known in the art. For example, such an antibody multimer contains a variable heavy chain connected to a variable light chain on the same polypeptide chain (VH-VL) connected by a peptide linker that is too short to allow pairing between the two domains on the same chain. This forces pairing with the complementary domains of another chain and promotes the assembly of a dimeric molecule with two functional antigen binding sites. An example of the construction of scFv dimers is given in Goel et al., (2000) *Cancer Research* 60:6964-6971.

Alternatively, antibodies can be made to multimerize through recombinant DNA techniques. IgM and IgA naturally form antibody multimers through the interaction with the mature J chain polypeptide (e.g., SEQ ID NO:2930). Non-IgA or non-IgM molecules, such as IgG molecules, can be engineered to contain the J chain interaction domain of IgA or IgM, thereby conferring the ability to form higher order multimers on the non-IgA or non-IgM molecules. (see, for example, Chintalacharuvu et al., (2001) *Clinical Immunology* 101:21-31. and Frigerio et al., (2000) *Plant Physiology* 123:1483-94). IgA dimers are naturally secreted into the lumen of mucosa-lined organs. This secretion is mediated through interaction of the J chain with the polymeric IgA receptor (pIgR) on epithelial cells. If secretion of an IgA form of an antibody (or of an antibody engineered to contain a J chain interaction domain) is not desired, it can be greatly reduced by expressing the antibody molecule in association with a mutant J chain that does not interact well with pIgR (e.g., SEQ ID NOS:2931-2933; Johansen et al., *The Journal of Immunology* (2001) 167:5185-5192). SEQ ID NO:2931 is a mutant form of a human mature J chain with C134S mutation compared to the mature form of human J chain (SEQ ID NO:2930). SEQ ID NO:2932 is a mutant form of a human mature J chain with amino acids 113-137 deleted compared to the mature form of human J chain (SEQ ID NO:2930). SEQ ID NO:2933 shows a mutant form of human mature J chain with C109S and C134S mutation compared to the mature form of human J chain (SEQ ID NO:2930). Expression of an antibody with one of these mutant J chains will reduce its ability to bind to the polymeric IgA receptor on epithelial cells, thereby reducing transport of the antibody across the epithelial cell and its resultant secretion into the lumen of mucosa lined organs.

Antibody multimers may be purified using any suitable method known in the art, including, but not limited to, size exclusion chromatography. Exemplary methods for purifying antibodies are described elsewhere herein.

Exemplary Antibodies

An exemplary antibody multimer provided herein contains a variable heavy chain that contains a CDRH1 (corresponding to amino acid positions 26-35 based on kabat numbering) that has a sequence of amino acids of SYYMH (SEQ ID NO:2920), such as GYTFTSYYMH (SEQ ID NO: 2908), a CDRH2 (corresponding to amino acid positions 50-65 based on kabat numbering) that has a sequence of amino acids of IINPSGGSTSYAQKFQG (SEQ ID NO:2909), and a CDRH3 (corresponding to amino acid positions 95-102) that has a sequence of amino acids of EEYSSSSAEYFQH (SEQ ID NO:2910); and contains a variable light chain that contains a CDRL1 (corresponding to amino acid positions 24 to 33 or 34 based on kabat numbering) that has a sequence of amino acids of RASQSVSSYLA (SEQ ID NO: 2911), a CDRL2 (corresponding to amino acid positions 50-56 based on kabat numbering) that has a sequence of amino acids of amino acids of DASNRAT (SEQ ID NO:2912), and a CDRL3 (corresponding to amino acid positions 89-97 based on kabat numbering) that has a sequence of amino acids of QQRSNWPPWT (SEQ ID NO:2913). Also provided are antibody multimers that have a variable heavy chain containing a CDRH1, CDRH2 and CDRH3 that is at least 70% identical to any of SEQ ID NOS:2908-2910, respectively and a variable light chain containing a CDRL1, CDRL2, and CDRL3 that is at least 70% identical to any of SEQ ID NOS:2911-2913, respectively, whereby the antibody multimer binds to DLL4 and is an activator of DLL4. For example, sequence identity can be at or about 70%, 75%, 80%, 85%, 90%, 91%, 92%, 93%, 94%, 95%, 96%, or more. For example, the antibody multimer is an antibody that at least contains a variable heavy chain set forth in SEQ ID NO:88 and a variable light chain set forth in SEQ ID NO:107, or a variable heavy chain or variable light chain that is at least 60% identical to SEQ ID NO:88 and/or 107, respectively. The antibody can be multimerized as described herein above. For example, provided herein is an antibody multimer that has a heavy chain containing a variable heavy chain region set forth in SEQ ID NO:88, and a CH1-hinge-CH2-CH3 set forth in SEQ ID NO: 2922, and contains a light chain containing a variable light chain set forth in SEQ ID NO:107 and a kappa or lambda CL chain set forth in SEQ ID NO:2923 or 2924.

In another example, an exemplary antibody multimer provided herein contains a variable heavy chain that contains a CDRH1 (corresponding to amino acid positions 26-35 based on kabat numbering) that has a sequence of amino acids of SYWIG (SEQ ID NO: 2921), such as GYSFTSYWIG (SEQ ID NO:2914), a CDRH2 (corresponding to amino acid positions 50-65 based on kabat numbering) that has a sequence of amino acids of IIYPGDSDTRYSPSFQG (SEQ ID NO:2915), and a CDRH3 (corresponding to amino acid positions 95-102) that has a sequence of amino acids of RGYSYGYDYFDY (SEQ ID NO:2916); a contains a variable light chain that contains CDRL1 (corresponding to amino acid positions 24 to 33 or 34 based on kabat numbering) that has a sequence of amino acids of GLSSGSVSTSYYPS (SEQ ID NO:2917); a CDRL2 (corresponding to amino acid positions 50-56 based on kabat numbering) that has a sequence of amino acids of amino acids of STNTRSS (SEQ ID NO: 2918); and a CDRL3 (corresponding to amino acid positions 89-97 based on kabat numbering) that has a sequence of amino acids of VLYMGSGISYV (SEQ ID NO:2919). Also provided are antibody multimers that have a variable heavy chain containing a CDRH1, CDRH2 and CDRH3 that is at least 70% identical to any of SEQ ID NOS:2914-2916, respectively and a variable light chain containing a CDRL1, CDRL2, and CDRL3 that is at least 70% identical to any of SEQ ID NOS:2917-2919, respectively, whereby the antibody multimer binds to DLL4 and is an activator of DLL4. For example, sequence identity can be at or about 70%, 75%, 80%, 85%, 90%, 91%, 92%, 93%, 94%, 95%, 96%, or more.

For example, the antibody multimer is an antibody that at least contains a variable heavy chain set forth in SEQ ID NO:89 and a variable light chain set forth in SEQ ID NO:108, or a variable heavy chain or variable light chain that is at least 60% identical to SEQ ID NO:89 and/or 108, respectively. The antibody can be multimerized as described herein above. For example, provided herein is an antibody multimer that has a heavy chain containing a variable heavy chain region set forth in SEQ ID NO:89, and a CH1-hinge-CH2-CH3 set forth in SEQ ID NO: 2922, and contains a light chain containing a variable light chain set forth in SEQ ID NO:108 and a kappa or lambda CL chain set forth in SEQ ID NO:2923 or 2924.

In some examples, that anti-DLL4 antibody multimers provided herein include activator/modulators of DLL4 activity, with the proviso that the antibody is not an antibody that has a heavy chain containing a variable heavy chain set forth in SEQ ID NO:88 and a variable light chain set forth in SEQ ID NO:107; or is not an antibody that has a heavy chain containing a variable heavy chain set forth in SEQ ID NO:89 and a variable light chain set forth in SEQ ID NO:108.

3. Modifications

The anti-DLL4 antibody multimers provided herein can be further modified so long as the antibody retains binding to DLL4 and is an activator of DLL4 activity. Modification of an anti-DLL4 antibody multimer provided herein can improve one or more properties of the antibody, including, but not limited to, decreasing the immunogenicity of the antibody; improving the half-life of the antibody, such as reducing the susceptibility to proteolysis and/or reducing susceptibility to oxidation; altering or improving of the binding properties of the antibody; and/or modulating the effector functions of the antibody. Exemplary modifications include modification of the primary sequence of the antibody and/or alteration of the post-translational modification of an antibody. Exemplary post-translational modifications include, for example, glycosylation, acetylation, pegylation, phosphorylation, amidation, derivatization with protecting/blocking group, proteolytic cleavage, and linkage to a cellular ligand or other protein. Other exemplary modifications include attachment of one or more heterologous peptides to the antibody to alter or improve one or more properties of the antibody.

Generally, the modifications do not result in increased immunogenicity of the antibody or antigen-binding fragment thereof or significantly negatively affect the binding of the antibody to DLL4 or its activity as an activator. Methods of assessing the binding of the modified antibodies to DLL4 are provided herein and are known in the art. For example, modified antibodies can be assayed for binding to DLL4 by methods such as, but not limited to, ELISA or FACS binding assays. Methods to assess activating activity of the antibody also are known to one of skill in the art and described elsewhere herein, for examples, in the Examples. For example, activity can be determined using a reporter assay for activity of a Notch receptor.

Modification of the anti-DLL4 antibodies produced herein can include one or more amino acid substitutions, deletions or additions, compared to the parent antibody from which it was derived. Methods for modification of polypeptides, such as antibodies, are known in the art and can be employed for the modification of any antibody or antigen-binding fragment provided herein. Standard techniques known to those of skill in the art can be used to introduce mutations in the nucleotide molecule encoding an antibody or an antigen-binding fragment provided herein in order to produce a polypeptide with one or more amino acid substitutions. Exemplary techniques for introducing mutations include, but are not limited to, site-directed mutagenesis and PCR-mediated mutagenesis.

The antibodies can be recombinantly fused to a heterologous polypeptide at the N-terminus or C-terminus or chemically conjugated, including covalent and non-covalent conjugation, to a heterologous polypeptide or other composition. The fusion does not necessarily need to be direct, but can occur through a linker peptide. In some examples, the linker peptide contains a protease cleavage site which allows for removal of the purification peptide following purification by cleavage with a protease that specifically recognizes the protease cleavage site.

For example, the anti-DLL4 antibodies provided herein can be modified by the attachment of a heterologous peptide to facilitate purification. Generally such peptides are expressed as a fusion protein containing the antibody fused to the peptide at the C- or N-terminus of the antibody. Exemplary peptides commonly used for purification include, but are not limited to, hexa-histidine peptides, hemagglutinin (HA) peptides, and flag tag peptides (see e.g., Wilson et al. (1984) *Cell* 37:767; Witzgall et al. (1994) *Anal Biochem* 223:2, 291-8). In another example, the anti-DLL4 antibodies provided herein can be modified by the covalent attachment of any type of molecule, such as a diagnostic or therapeutic molecule. Exemplary diagnostic and therapeutic moieties include, but are not limited to, drugs, radionucleotides, toxins, fluorescent molecules (see, e.g. International PCT Publication Nos. WO 92/08495; WO 91/14438; WO 89/12624; U.S. Pat. No. 5,314,995; and EP 396,387). Diagnostic polypeptides or diagnostic moieties can be used, for example, as labels for in vivo or in vitro detection. In a further example, anti-DLL4 antibody multimers provided herein can be modified by attachment to other molecules or moieties, such as any that increase the half-life, stability, immunogenicity or that affect or alter the targeting of the antibody in vivo.

Exemplary modifications are described herein below. It is within the level of one of skill in the art to modify any of the antibodies provided herein depending on the particular application of the antibody.

a. Modifications to Reduce Immunogenicity

In some examples, the antibodies provided herein can be modified to reduce the immunogenicity in a subject, such as a human subject. For example, one or more amino acids in the antibody can be modified to alter potential epitopes for human T-cells in order to eliminate or reduce the immunogenicity of the antibody when exposed to the immune system of the subject. Exemplary modifications include substitutions, deletions and insertion of one or more amino acids, which eliminate or reduce the immunogenicity of the antibody. Generally, such modifications do not alter the binding specificity of the antibody for its respective antigen. Reducing the immunogenicity of the antibody can improve one or more properties of the antibody, such as, for example, improving the therapeutic efficacy of the antibody and/or increasing the half-life of the antibody in vivo.

b. Glycosylation

The anti-DLL4 antibodies provided herein can be modified by either N-linked or O-linked glycosylation. N-linked glycosylation includes the attachment of a carbohydrate moiety to the side chain of an asparagine residue within the tripeptide sequences asparagine-X-serine and asparagine-X-threonine, where X is any amino acid except proline. O-linked glycosylation includes the attachment of one of the sugars N-aceylgalactosamine, galactose, or xylose to a hydroxyamino acid, most commonly serine or threonine, although 5-hydroxyproline or 5-hydroxylysine can also be used. The anti-DLL4 antibodies can be further modified to incorporate additional glycosylation sites by altering the amino acid sequence such that it contains one or more of the above-described tripeptide sequences (for N-linked glycosylation sites). The alteration can also be made by the addition of, or substitution by, one or more serine or threonine residues to the sequence of the original antibody (for O-linked glycosylation sites). Where the antibody comprises an Fc region, the carbohydrate attached thereto can be altered (see, e.g., U.S. Patent Pub. Nos. 2003/0157108, 2005/0123546 and US 2004/0093621; International Patent Pub. Nos. WO 2003/011878, WO 1997/30087, WO 1998/58964, WO 1999/22764; and U.S. Pat. No. 6,602,684).

For example, a glycosylation variantion is in the Fc region of the antibody, wherein a carbohydrate structure attached to the Fc region lacks fucose. Such variants have improved ADCC function. Optionally, the Fc region further contains one or more amino acid substitutions therein which further improve ADCC, for example, substitutions at positions 298, 333, and/or 334 of the Fc region (Eu numbering of residues) (see, e.g., US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; Okazaki et al. *J. Mol. Biol.* 336:1239-1249 (2004); Yamane-Ohnuki et al. *Biotech. Bioeng.* 87: 614 (2004)). Examples of cell lines producing defucosylated antibodies include Lec13 CHO cells deficient in protein fucosylation (Ripka et al. *Arch. Biochem. Biophys.* 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (Yamane-Ohnuki et al. *Biotech. Bioeng.* 87: 614 (2004)).

c. Fc Modifications

The anti-DLL4 antibody multimers provided herein can contain wild-type or modified Fc region. The antibodies provided herein can be engineered to contain modified Fc regions. In some examples, the Fc region can be modified to alter one or more properties of the Fc polypeptide. For example, the Fc region can be modified to alter (i.e. increase or decrease) effector functions compared to the effector function of an Fc region of a wild-type immunoglobulin heavy chain. Thus, a modified Fc domain can have altered affinity, including but not limited to, increased or low or no affinity for the Fc receptor. Altering the affinity of an Fc region for a receptor can modulate the effector functions induced by the Fc domain.

In one example, an Fc region is used that is modified for optimized binding to certain FcγRs to better mediate effector functions, such as for example, antibody-dependent cellular cytotoxicity, ADCC. Such modified Fc regions can contain modifications at one or more of amino acid residues (according to the Kabat numbering scheme, Kabat et al. (1991) Sequences of Proteins of Immunological Interest, U.S. Department of Health and Human Services), including, but not limited to, amino acid positions 249, 252, 259, 262, 268, 271, 273, 277, 280, 281, 285, 287, 296, 300, 317, 323, 343, 345, 346, 349, 351, 352, 353, and 424. For example, modifications in an Fc region can be made corresponding to any one or more of G119S, G119A, S122D, S122E, S122N, S122Q, S122T, K129H, K129Y, D132Y, R138Y, E141Y, T143H, V147I, S150E, H151D, E155Y, E155I, E155H, K157E, G164D, E166L, E166H, S181A, S181D, S187T, S207G, S207I, K209T, K209E, K209D, A210D, A213Y, A213L, A213I, I215D, I215E, I215N, I215Q, E216Y, E216A, K217T, K217F, K217A, and P279L of the exemplary Fc sequence set forth in SEQ ID NO:2922, or combinations thereof. A modified Fc containing these mutations can have enhanced binding to an FcR such as, for example, the activating receptor FcγIIIa and/or can have reduced binding to the inhibitory receptor FcγRIIb (see e.g., US 2006/0024298). Fc regions modified to have increased binding to FcRs can be more effective in facilitating the destruction of the fungal cells in patients.

In some examples, the antibodies or antigen-binding fragments provided herein can be further modified to improve the interaction of the antibody with the FcRn receptor in order to increase the in vivo half-life and pharmacokinetics of the antibody (see, e.g. U.S. Pat. No. 7,217,797; and U.S Pat. Pub. Nos. 2006/0198840 and 2008/0287657). FcRn is the neonatal FcR, the binding of which recycles endocytosed antibody from the endosomes back to the bloodstream. This process, coupled with preclusion of kidney filtration due to the large size of the full length molecule, results in favorable antibody serum half-lives ranging from one to three weeks. Binding of Fc to FcRn also plays a role in antibody transport.

Exemplary modifications of the Fc region include but are not limited to, mutation of the Fc described in U.S. Pat. No. 7,217,797; U.S Pat. Pub. Nos. 2006/0198840, 2006/0024298 and 2008/0287657; and International Patent Pub. No. WO 2005/063816, such as mutations at one or more of amino acid residues (Kabat numbering, Kabat et al. (1991)) 251-256, 285-90, 308-314, in the $C_H2$ domain and/or amino acids residues 385-389, and 428-436 in the $C_H3$ domain of the Fc heavy chain constant region, where the modification alters Fc receptor binding affinity and/or serum half-life relative to unmodified antibody. In some examples, the Fc region is modified at one or more of amino acid positions 250, 251, 252, 254, 255, 256, 263, 308, 309, 311, 312 and 314 in the $C_H2$ domain and/or amino acid positions 385, 386, 387, 389, 428, 433, 434, 436, and 459 in the $C_H3$ domain of the Fc heavy chain constant region. Such modifications correspond to amino acids Gly120, Pro121, Ser122, Phe124 Leu125, Phe126, Thr133, Pro174, Arg175, Glu177, Gln178, and Asn180 in the $C_H2$ domain and amino acids Gln245, Val246, Ser247, Thr249, Ser283, Gly285, Ser286, Phe288, and Met311 in the $C_H3$ domain in an exemplary Fc sequence set forth in SEQ ID NO:2922 In some examples, the modification is at one or more surface-exposed residues, and the modification is a substitution with a residue of similar charge, polarity or hydrophobicity to the residue being substituted.

In particular examples, a Fc heavy chain constant region is modified at one or more of amino acid positions 251, 252, 254, 255, and 256 (Kabat numbering), where position 251 is substituted with Leu or Arg, position 252 is substituted with Tyr, Phe, Ser, Trp or Thr, position 254 is substituted with Thr or Ser, position 255 is substituted with Leu, Gly, Ile or Arg, and/or position 256 is substituted with Ser, Arg, Gln, Glu, Asp, Ala, Asp or Thr. In some examples, a Fc heavy chain constant region is modified at one or more of amino acid positions 308, 309, 311, 312, and 314 (Kabat numbering), where position 308 is substituted with Thr or Ile, position 309 is substituted with Pro, position 311 is substituted with serine or Glu, position 312 is substituted with Asp, and/or position 314 is substituted with Leu. In some examples, a Fc heavy chain constant region is modified at one or more of amino acid positions 428, 433, 434, and 436 (Kabat numbering), where position 428 is substituted with Met, Thr, Leu, Phe, or Ser, position 433 is substituted with Lys, Arg, Ser, Ile, Pro, Gln, or His, position 434 is substituted with Phe, Tyr, or His, and/or position 436 is substituted with His, Asn, Asp, Thr, Lys, Met, or Thr. In some examples, a Fc heavy chain constant region is modified at one or more of amino acid positions 263 and 459 (Kabat numbering), where position 263 is substituted with Gln or Glu and/or position 459 is substituted with Leu or Phe.

In some examples, a Fc heavy chain constant region can be modified to enhance binding to the complement protein C1q. In addition to interacting with FcRs, Fc also interact with the complement protein C1q to mediate complement dependent cytotoxicity (CDC). C1q forms a complex with the serine proteases C1r and C1s to form the C1 complex. C1q is capable of binding six antibodies, although binding to two IgGs is sufficient to activate the complement cascade. Similar to Fc interaction with FcRs, different IgG subclasses have different affinity for C1q, with IgG1 and IgG3 typically binding substantially better than IgG2 and IgG4. Thus, a modified Fc having increased binding to C1q can mediate enhanced CDC, and can enhance destruction of fungal cells. Exemplary modifications in an Fc region that increase binding to C1q include, but are not limited to, amino acid modifications at positions 345 and 253 (Kabat numbering). Exemplary modifications are include those corresponding to K209W, K209Y, and E216S in an exemplary Fc sequence set forth in SEQ ID NO:2922.

In another example, a variety of Fc mutants with substitutions to reduce or ablate binding with FcγRs also are known. Such muteins are useful in instances where there is a need for reduced or eliminated effector function mediated by Fc. This is often the case where antagonism, but not killing of the cells bearing a target antigen is desired. Exemplary of such an Fc is an Fc mutein described in U.S. Pat. No. 5,457,035, which is modified at amino acid positions 248, 249 and 251 (Kabat numbering). In an exemplary Fc sequence set forth in amino acids 100-330 of SEQ ID NO:2922, amino acid 118 is modified from Leu to Ala, amino acid 119 is modified from Leu to Glu, and amino acid 121 is modified from Gly to Ala. Similar mutations can be made in any Fc sequence such as, for example, the exemplary Fc sequence. This mutein exhibits reduced affinity for Fc receptors.

d. Pegylation

The anti-DLL4 antibody multimers provided herein can be conjugated to polymer molecules, or water soluble polymers, such as high molecular weight polyethylene glycol (PEG) to increase half-life and/or improve their pharmacokinetic profiles. Water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde can have advantages in manufacturing due to its stability in water. The polymer can be of any molecular weight, and can be branched or unbranched. The number of polymers attached to the antibody can vary, and if more than one polymer is attached, they can be the same or different molecules. In general, the number and/or type of polymers used for derivatization can be determined based on considerations including, but not limited to, the particular properties or functions of the antibody to be improved, and whether the antibody derivative will be used in a therapy under defined conditions.

Conjugation can be carried out by techniques known to those skilled in the art. Conjugation of therapeutic antibodies with PEG has been shown to enhance pharmacodynamics while not interfering with function (see, e.g., Deckert et al., *Int. J. Cancer* 87: 382-390, 2000; Knight et al., *Platelets* 15: 409-418, 2004; Leong et al., *Cytokine* 16: 106-119, 2001; and Yang et al., *Protein Eng.* 16: 761-770, 2003). PEG can be attached to the antibodies or antigen-binding fragments with or without a multifunctional linker either through site-specific conjugation of the PEG to the N- or C-terminus of the antibodies or antigen-binding fragments or via epsilon-amino groups present on lysine residues. Linear or branched polymer derivatization that results in minimal loss of biological activity can be used. The degree of conjugation can be monitored by SDS-PAGE and mass spectrometry to ensure proper conjugation of PEG molecules to the antibodies. Unreacted PEG can be separated from antibody-PEG conjugates by, e.g., size exclusion or ion-exchange chromatography. PEG-derivatized antibodies can be tested for binding activity to DLL4 as well as for in vivo efficacy using methods known to those skilled in the art, for example, by functional assays described herein.

4. Compositions, Formulations, Administration and Articles of Manufacture/Kits a. Compositions and Formulations The antibody multimers provided herein can be provided as a formulation for administration. While it is possible for the active ingredient to be administered alone, generally it is present as a pharmaceutical formulation. Compositions or formulations contain at least one active ingredient, together with one or more acceptable carriers thereof. Each carrier must be both pharmaceutically and physiologically acceptable in the sense of being compatible with the other ingredients and not injurious to the patient. Formulations include those suitable for oral, rectal, nasal, or parenteral (including subcutaneous, intramuscular, intravenous and intradermal) administration. The formulations can conveniently be presented in unit dosage form and can be prepared by methods well known in the art of pharmacy. See, e.g., Gilman, et al. (eds. 1990) Goodman and Gilman's: The Pharmacological Bases of Therapeutics, 8th Ed., Pergamon Press; and Remington's Pharmaceutical Sciences, 17th ed. (1990), Mack Publishing Co., Easton, Pa.; Avis, et al. (eds. 1993) Pharmaceutical Dosage Forms: Parenteral Medications Dekker, NY; Lieberman, et al. (eds. 1990) Pharmaceutical Dosage Forms: Tablets Dekker, NY; and Lieberman, et al. (eds. 1990) Pharmaceutical Dosage Forms: Disperse Systems Dekker, NY.

The route of antibody administration is in accord with known methods, e.g., injection or infusion by intravenous, intraperitoneal, intracerebral, intramuscular, subcutaneous, intraocular, intraarterial, intrathecal, inhalation or intralesional routes, topical or by sustained release systems as noted below. The antibody is typically administered continuously by infusion or by bolus injection. One can administer the antibodies in a local or systemic manner.

The antibody multimers provided herein can be prepared in a mixture with a pharmaceutically acceptable carrier. Techniques for formulation and administration of the compounds are known to one of skill in the art (see e.g. "Remington's Pharmaceutical Sciences," Mack Publishing Co., Easton, Pa.). This therapeutic composition can be administered intravenously or through the nose or lung, preferably as a liquid or powder aerosol (lyophilized). The composition also can be administered parenterally or subcutaneously as desired. When administered systematically, the therapeutic composition should be sterile, pyrogen-free and in a parenterally acceptable solution having due regard for pH, isotonicity, and stability. These conditions are known to those skilled in the art.

Therapeutic formulations can be administered in many conventional dosage formulations. Briefly, dosage formulations of the antibodies provided herein are prepared for storage or administration by mixing the compound having the desired degree of purity with physiologically acceptable carriers, excipients, or stabilizers. Such materials are non-toxic to the recipients at the dosages and concentrations employed, and can include buffers such as TRIS HCl, phosphate, citrate, acetate and other organic acid salts; antioxidants such as ascorbic acid; low molecular weight (less than about ten residues) peptides such as polyarginine, proteins, such as serum albumin, gelatin, or immunoglobulins; hydrophilic polymers such as polyvinylpyrrolidinone; amino acids such as glycine, glutamic acid, aspartic acid, or arginine; monosaccharides, disaccharides, and other carbohydrates including cellulose or its derivatives, glucose, mannose, or dextrins; chelating agents such as EDTA; sugar alcohols such as mannitol or sorbitol; counterions such as sodium and/or nonionic surfactants such as TWEEN, PLURONICS or polyethyleneglycol.

When used for in vivo administration, the antibody multimer formulation should be sterile and can be formulated according to conventional pharmaceutical practice. This is readily accomplished by filtration through sterile filtration membranes, prior to or following lyophilization and reconstitution. The antibody ordinarily will be stored in lyophilized form or in solution. Other vehicles such as naturally occurring vegetable oil like sesame, peanut, or cottonseed oil or a synthetic fatty vehicle like ethyl oleate or the like may be desired. Buffers, preservatives, antioxidants and the like can be incorporated according to accepted pharmaceutical practice.

Pharmaceutical compositions suitable for use include compositions wherein one or more antibody multimers are contained in an amount effective to achieve their intended purpose. Determination of a therapeutically effective amount is well within the capability of those skilled in the art, especially in light of the detailed disclosure provided herein. Therapeutically effective dosages can be determined by using in vitro and in vivo methods.

An effective amount of antibody to be employed therapeutically will depend, for example, upon the therapeutic objectives, the route of administration, and the condition of the patient. In addition, the attending physician takes into consideration various factors known to modify the action of drugs including severity and type of disease, body weight, sex, diet, time and route of administration, other medications and other relevant clinical factors. Accordingly, it will be necessary for the therapist to titer the dosage and modify the route of administration as required to obtain the optimal therapeutic effect. Typically, the clinician will administer antibody until a dosage is reached that achieves the desired effect. The progress of this therapy is easily monitored by conventional assays.

For any antibody containing a peptide, the therapeutically effective dose can be estimated initially from cell culture assays. For example, a dose can be formulated in animal models to achieve a circulating concentration range that includes the EC50 as determined in cell culture (e.g., the concentration of the test molecule which promotes or inhibits cellular proliferation or differentiation). Such information can be used to more accurately determine useful doses in humans.

Toxicity and therapeutic efficacy of the antibody multimers described herein can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio between LD50 and ED50. Molecules which exhibit high therapeutic indices can be used. The data obtained from these cell culture assays and animal studies can be used in formulating a range of dosage for use in human. The dosage of such molecules lies preferably within a range of circulating concentrations that include the ED50 with little or no toxicity. The dosage may vary within this range depending upon the dosage form employed and the route of administration utilized. The exact formulation, route of administration and dosage can be chosen by the individual physician in view of the patient's condition. (See e.g., Fingl et al., 1975, in "The Pharmacological Basis of Therapeutics", Ch. 1, p.1).

Dosage amount and interval can be adjusted individually to provide plasma levels of the antibody which are sufficient to promote or inhibit cellular proliferation or differentiation or minimal effective concentration (MEC). The MEC will vary for each antibody, but can be estimated from in vitro data using described assays. Dosages necessary to achieve the MEC will depend on individual characteristics and route of administration. However, HPLC assays or bioassays can be used to determine plasma concentrations.

Dosage intervals can also be determined using MEC value. Antibody molecules should be administered using a regimen which maintains plasma levels above the MEC for 10-90% of the time, preferably between 30-90% and most preferably between 50-90%.

In cases of local administration or selective uptake, the effective local concentration of the antibody may not be related to plasma concentration.

A typical daily dosage might range of antibody multimers provided herein is from about 1 µ/kg to up to 1000 mg/kg or more, depending on the factors mentioned above. Typically, the clinician will administer the molecule until a dosage is reached that achieves the desired effect. The progress of this therapy is easily monitored by conventional assays.

Depending on the type and severity of the disease, from about 0.001 mg/kg to abut 1000 mg/kg, such as about 0.01 mg to 100 mg/kg, for example about 0.010 to 20 mg/kg of the antibody multimer, is an initial candidate dosage for administration to the patient, whether, for example, by one or more separate administrations, or by continuous infusion. For repeated administrations over several days or longer, depending on the condition, the treatment is repeated until a desired suppression of disease symptoms occurs or the desired improvement in the patient's condition is achieved. However, other dosage regimes also are contemplated.

b. Articles of Manufacture and Kits

Pharmaceutical compounds of selected antibodies or nucleic acids encoding selected antibodies, or a derivative or a biologically active portion thereof can be packaged as articles of manufacture containing packaging material, a pharmaceutical composition which is effective for treating the disease or disorder, and a label that indicates that selected antibody or nucleic acid molecule is to be used for treating the disease or disorder.

The articles of manufacture provided herein contain packaging materials. Packaging materials for use in packaging pharmaceutical products are well known to those of skill in the art. See, for example, U.S. Pat. Nos. 5,323,907, 5,052,558 and 5,033,252, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any EPO-mediated disease or disorder or therapeutic polypeptide-mediated disease or disorder.

Antibodies and nucleic acid molecules encoding the antibodies thereof also can be provided as kits. Kits can include a pharmaceutical composition described herein and an item for administration. For example, a selected antibody can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of the antibody in a subject.

5. Methods of Treatment and Uses

Provided herein are methods of treatment or uses of anti-DLL4 antibody multimers to treat diseases that manifest aberrant angiogenesis or neovascularization. Angiogenesis is a process by which new blood vessels are formed. It occurs for example, in a healthy body for healing wounds and for restoring blood flow to tissues after injury or insult. In females, angiogenesis also occurs during the monthly reproductive cycle to rebuild the uterus lining, to mature the egg during ovulation and during pregnancy to build the placenta. In some situations 'too much' angiogenesis can be detrimental, such as angiogenesis that supplies blood to tumor foci, in inflammatory responses and other aberrant angiogenic-related conditions. The growth of tumors, or sites of proliferation in chronic inflammation, generally requires the recruitment of neighboring blood vessels and vascular endothelial cells to support their metabolic requirements. This is because the diffusion is limited for oxygen in tissues. Exemplary conditions associated with angiogenesis include, but are not limited to solid tumors and hematologic malignancies such as lymphomas, acute leukemia, and multiple myeloma, where increased numbers of blood vessels are observed in the pathologic bone marrow.

Hence, angiogenesis is implicated in the pathogenesis of a variety of disorders. These include solid tumors and metastasis, atherosclerosis, retrolental fibroplasia, hemangiomas, chronic inflammation, intraocular neovascular diseases such as proliferative retinopathies, e.g., diabetic retinopathy, age-related macular degeneration (AMD), neovascular glaucoma, immune rejection of transplanted corneal tissue and other tissues, rheumatoid arthritis, and psoriasis. Folkman et al., *J. Biol. Chem.* 267:10931-34 (1992); Klagsbrun et al., *Annu. Rev. Physiol.* 53:217-39 (1991); and Garner A., "Vascular diseases," In: Pathobiology of Ocular Disease. A Dynamic Approach, Garner A., Klintworth G K, eds., 2nd Edition (Marcel Dekker, N Y, 1994), pp 1625-1710.

In the case of tumor growth, angiogenesis appears to be crucial for the transition from hyperplasia to neoplasia, and for providing nourishment for the growth and metastasis of the tumor. Folkman et al., *Nature* 339:58 (1989). The neovascularization allows the tumor cells to acquire a growth advantage and proliferative autonomy compared to the normal cells. A tumor usually begins as a single aberrant cell which can proliferate only to a size of a few cubic millimeters due to the distance from available capillary beds, and it can stay 'dormant' without further growth and dissemination for a long period of time. Some tumor cells then switch to the angiogenic phenotype to activate endothelial cells, which proliferate and mature into new capillary blood vessels. These newly formed blood vessels not only allow for continued growth of the primary tumor, but also for the dissemination and recolonization of metastatic tumor cells. Accordingly, a correlation has been observed between density of microvessels in tumor sections and patient survival in breast cancer as well as in several other tumors. Weidner et al., *N. Engl. J. Med.* 324:1-6 (1991); Horak et al., *Lancet* 340:1120-24 (1992); Macchiarini et al., *Lancet* 340:145-46 (1992). The precise mechanisms that control the angiogenic switch is not well understood, but it is believed that neovascularization of tumor mass results from the net balance of a multitude of angiogenesis stimulators and inhibitors (Folkman, *Nat. Med.* 1(1):27-31 (1995)).

Angiogenesis also play a role in inflammatory diseases. These diseases have a proliferative component, similar to a tumor focus. In rheumatoid arthritis, one component of this is characterized by aberrant proliferation of synovial fibroblasts, resulting in pannus formation. The pannus is composed of synovial fibroblasts which have some phenotypic characteristics with transformed cells. As a pannus grows within the joint it expresses many proangiogenic signals, and experiences many of the same neo-angiogenic requirements as a tumor. The need for additional blood supply, neoangiogenesis, is critical. Similarly, many chronic inflammatory conditions also have a proliferative component in which some of the cells composing it may have characteristics usually attributed to transformed cells.

Another example of a condition involving excess angiogenesis is diabetic retinopathy (Lip et al. Br J Ophthalmology 88: 1543, 2004)). Diabetic retinopathy has angiogenic, inflammatory and proliferative components; overexpression of VEGF, and angiopoietin-2 are common. This overexpression is likely required for disease-associated remodeling and branching of blood vessels, which then supports the proliferative component of the disease.

Hence, provided herein are methods of treatment with anti-DLL4 antibody multimers for angiogenic diseases and conditions. Such diseases or conditions include, but are not limited to, inflammatory diseases, immune diseases, cancers, and other diseases that manifest aberrant angiogenesis and abnormal vascularization. Cancers include breast, lung, colon, gastric cancers, pancreatic cancers and others. Inflammatory diseases, include, for example, diabetic retinopathies and/or neuropathies and other inflammatory vascular complications of diabetes, autoimmune diseases, including autoimmune diabetes, atherosclerosis, Crohn's disease, diabetic kidney disease, cystic fibrosis, endometriosis, diabetes-induced vascular injury, inflammatory bowel disease, Alzheimers disease and other neurodegenerative diseases. Treatment can be effected by administering by suitable route formulations of the antibody multimers, which can be provided in compositions as polypeptides. In some examples, the antibody multimers can be linked to targeting agents, for targeted delivery or encapsulated in delivery vehicles, such as liposomes.

For example, treatments using the anti-DLL4 multimers provided herein, include, but are not limited to treatment of diabetes-related diseases and conditions including periodontal, autoimmune, vascular, and tubulointerstitial diseases. Treatments using the anti-DLL4 antibody multimers also include treatment of ocular disease including macular degeneration, cardiovascular disease, neurodegenerative disease including Alzheimer's disease, inflammatory diseases and conditions including rhematoid arthritis, and diseases and conditions associated with cell proliferation including cancers. One of skill in the art can assess based on the type of disease to be treated, the severity and course of the disease, whether the molecule is administered for preventive or therapeutic purposes, previous therapy, the patient's clinical history and response to therapy, and the discretion of the attending physician appropriate dosage of a molecule to administer.

Combination Therapy

Anti-DLL4 antibody multimers provided herein can be administered in combination with another therapy. For example, anti-DLL4 antibody multimers are used in combinations with anti-cancer therapeutics or anti-neovascularization therapeutics to treat various neoplastic or non-neoplastic conditions. In one embodiment, the neoplastic or non-neoplastic condition is characterized by pathological disorder associated with aberrant or undesired angiogenesis. Exemplary combination therapies also include any set forth in U.S. Published application No. 20090246199. The anti-DLL4 antibody multimer can be administered serially or in combination with another agent that is effective for those purposes, either in the same composition or as separate compositions. The anti-DLL4 antibody multimers can be administered sequentially, simultaneously or intermittently with a therapeutic agent. Alternatively, or additionally, multiple inhibitors of DLL4 can be administered. The administration of the anti-DLL4 antibody multimer can be done simultaneously, e.g., as a single composition or as two or more distinct compositions using the same or different administration routes. Alternatively, or additionally, the administration can be done sequentially, in any order. In certain embodiments, intervals ranging from minutes to days, to weeks to months, can be present between the administrations of the two or more compositions. For example, the anti-cancer agent can be administered first, followed by the DLL4 antibody multimer. Simultaneous administration or administration of the anti-DLL4 antibody multimer first also is contemplated.

The effective amounts of therapeutic agents administered in combination with an anti-DLL4 antibody multimer will be at the physician's or veterinarian's discretion. Dosage administration and adjustment is done to achieve maximal management of the conditions to be treated. The dose will additionally depend on such factors as the type of therapeutic agent to be used and the specific patient being treated. Suitable dosages for the anti-cancer agent are those presently used and can be lowered due to the combined action (synergy) of the anti-cancer agent and the anti-DLL4 antibody multimer.

Typically, the anti-DLL4 antibody multimer and anti-cancer agents are suitable for the same or similar diseases to block or reduce a pathological disorder such as tumor growth or growth of a cancer cell. In one embodiment the anti-cancer agent is an anti-angiogenesis agent. Antiangiogenic therapy in relationship to cancer is a cancer treatment strategy aimed at inhibiting the development of tumor blood vessels required for providing nutrients to support tumor growth. Because angiogenesis is involved in both primary tumor growth and metastasis, the antiangiogenic treatment is generally capable of inhibiting the neoplastic growth of tumor at the primary site as well as preventing metastasis of tumors at the secondary sites, therefore allowing attack of the tumors by other therapeutics.

Many anti-angiogenic agents have been identified and are known in the arts, including those listed herein, e.g., listed under Definitions, and by, e.g., Carmeliet and Jain, *Nature* 407:249-257 (2000); Ferrara et al., *Nature Reviews. Drug Discovery*, 3:391-400 (2004); and Sato *Int. J. Clin. Oncol.*, 8:200-206 (2003). See also, US Patent Application US20030055006. In one embodiment, an anti-DLL4 antibody multimer is used in combination with an anti-VEGF neutralizing antibody (or fragment) and/or another VEGF antagonist or a VEGF receptor antagonist including, but not limited to, for example, soluble VEGF receptor (e.g., VEGFR-1, VEGFR-2, VEGFR-3, neuropillins (e.g., NRP1, NRP2)) fragments, aptamers capable of blocking VEGF or VEGFR, neutralizing anti-VEGFR antibodies, low molecule weight inhibitors of VEGFR tyrosine kinases (RTK), antisense strategies for VEGF, ribozymes against VEGF or VEGF receptors, antagonist variants of VEGF; and any combinations thereof. Alternatively, or additionally, two or more angiogenesis inhibitors can optionally be co-administered to the patient in addition to VEGF antagonist and other agent. In certain embodiment, one or more additional therapeutic agents, e.g., anti-cancer agents, can be administered in combination with anti-DLL4 antibody multimer, the VEGF antagonist, and an anti-angiogenesis agent.

In certain aspects, other therapeutic agents useful for combination angiogenic or tumor therapy with a anti-DLL4 antibody mulitmer include other cancer therapies, (e.g., surgery, radiological treatments (e.g., involving irradiation or administration of radioactive substances), chemotherapy, treatment with anti-cancer agents listed herein and known in the art, or combinations thereof). Alternatively, or additionally, two or more antibodies binding the same or two or more different antigens disclosed herein can be co-administered to the patient. Sometimes, it can be beneficial to also administer one or more cytokines to the patient.

H. Examples

The following examples are included for illustrative purposes only and are not intended to limit the scope of the invention.

Example 1

Generation of Mutant Fab Antibodies

In this Example, mutant Fab antibodies were generated by alanine-scanning, NNK mutagenesis, and ligation of oligo pairs into BsaI modified plasmids that allow cloning of any modified CDR region in a high-throughput manner.

A. Alanine Scanning Mutagenesis

Alanine mutants were generated by overlapping PCR using the parent heavy or light chain DNA as a template. Forward and reverse primers that specifically generate the desired mutation at the target codon were used to amplify the parent DNA in the appropriate plasmid.

In the first round of PCR, two separate PCR reactions with different primer pairs were used to amplify two segments of the gene. The first reaction used the specific reverse primer with an EcoRI forward primer and amplified the first half of the gene. The second reaction used the specific forward primer with an FLXhoI reverse primer and amplified the second half of the gene. The gene segments were generated using 20 cycles of PCR with the following conditions: 94°

C. for 30 sec; 50° C. for 30 sec; and 72° C. for 90 sec. The PCR products were isolated and purified from 1% agarose gel and mixed together as a template for the second round of PCR. In the second round of PCR, EcoRI forward and FLXhoI reverse primers were used to amplify the full length gene product. The gene product was generated using 20 cycles of PCR with the following conditions: 94° C. for 30 sec; 55° C. for 30 sec; and 72° C. for 90 sec.

The PCR product was isolated and subsequently digested with EcoRI and XhoI (New England Biolabs) and ligated into the similarly digested plasmid. After transformation of the ligation product in E. coli DH5α and plating, individual colonies were selected and grown in a 96-well block containing 1.5 ml of Terrific Broth (EMD, San Diego, Calif.) supplemented with 50 μg/ml Kanamycin, and 0.4% glucose, and grown at 37° C. overnight. The DNA was isolated using a mini-prep kit (Qiagen) and alanine mutations were confirmed by DNA sequencing.

As an example, Table 6 sets forth primer pairs used to generate the mutant VH5-51_IGHD5-18*01>3_IGHJ4*01 R99A and VH1-46_IGHD6-6*01_IGHJ1*01 E100A. Primers R99A_F and R99A_R were utilized to specifically amplify the R99 to alanine mutation. Primers E100A_F and E100A_R were utilized to specifically amplify the E100 to alanine mutation. Primers EcoRI_F and FLXhoI_R were utilized to amplify the remaining segments of the gene.

TABLE 6

Example primer pairs for alanine scanning mutagenesis

| Primer | Sequence | SEQ ID NO |
|---|---|---|
| VH5-51_IGHD5-18*01>3_IGHJ4*01 | | |
| R99A_F | GCCATGTATTACTGTGCGAGAGCCGGATACAGCTATGGTTACGAC | 1 |
| R99A_R | GTCGTAACCATAGCTGTATCCGGCTCTCGCACAGTAATACATGGC | 2 |
| VH1-46_IGHD6-6*01_IGHJ1*01 | | |
| E100A_F | GTGTATTACTGTGCGAGAGAGGCCTATAGCAGCTCGTCCGCTG | 3 |
| E100A_R | CAGCGGACGAGCTGCTATAGGCCTCTCTCGCACAGTAATACAC | 4 |
| Plasmid A and D | | |
| EcoRI_F | TTGGGCGAATTCCCTAGATAATTAATTAGGAGG | 5 |
| FLXhoI_R | TTAAACCTCGAGCCGCGGTTCATTAAAG | 6 |

B. NNK Mutagenesis by Overlapping PCR

NNK mutagenesis by overlapping PCR was carried out as described above for alanine scanning mutagenesis, with initial primers that generate the desired NNK mutations. Therefore, in the first round of PCR, specific primer pairs were used in which the target codon was replaced with NNK (forward) and MNN (reverse). For example, Table 7 below sets forth forward and reverse primers used to generate VH5-51_IGHD5-18*01>3_IGHJ4*01 G100 NNK mutants and VH1-46_IGHD6-6*01_IGHJ1*01 S102 NNK mutants.

Individual clones were subjected to DNA sequencing (by BATJ, Inc., San Diego, Calif.) to identify the amino acid substitution. Depending on the number of colonies picked per NNK mutation reaction, mutation rate varies—as low as 4 to 5 amino acid changes, and as high as 18 to 19 amino acid changes per mutation were observed.

TABLE 7

Example primer pairs for NNK mutagenesis

| Primer | Sequence | SEQ ID NO |
|---|---|---|
| VH5-51_IGHD5-18*01>3_IGHJ4*01 | | |
| G100_NNK_F | GTATTACTGTGCGAGACGTNNKTACAGCTATGGTTACGAC | 7 |
| G100_NNK_R | GTCGTAACCATAGCTGTAMNNACGTCTCGCACAGTAATAC | 8 |
| VH1-46_IGHD6-6*01_IGHJ1*01 | | |
| S102_NNK_F | TGCGAGAGAGGGGTATNNKAGCAGCTGGTACGACT | 9 |
| S102_NNK_R | AGTCGTACCAGCTGCTMNNATACCCCTCTCTCGCA | 10 |

C. Cassette Mutagenesis Using Type II Restriction Enzyme Based Digestion and Ligation of Oligo Pairs In this example, Fab mutants were generated in a in a high-throughput manner by cloning of specific synthetic CDR1, CDR2 and/or CDR3 sequences into plasmids previously modified to contain BsaI cloning sites. Specifically, for each heavy or light chain, three vectors each were generated whereby a BsaI restriction site was incorporated at both the 5' and 3' end of each CDR region. To generate Fab mutants, forward and reverse primers encoding a CDR with specific mutations and additionally BsaI overlapping ends were synthesized and annealed. These cassettes, or mutated CDR regions, were then ligated into the corresponding BsaI digested vector, thereby generating a plasmid containing a specifically modified CDR region.

For example, specific primers were synthesized (IDT, see Table 8 below) and used to generate three vectors each for heavy chains VH1-46_IGHD6-6*01_IGHJ1*01 and VH5-51_IGHD5-18*01>3_IGHJ4*01 and light chains L6_IGKJ1*01 and V3-4_IGLJ1*01, to incorporate a BsaI site at the beginning and end of CDR1, CDR2 and CDR3. The vectors were generated as described above using the specific forward and reverse primers in the first round of PCR and the parent heavy or light chain DNA as a template. Individual clones were subjected to DNA sequencing (by BATJ, Inc., San Diego, Calif.) to confirm the incorporation of two BsaI sites in each CDR.

Subsequently, each BsaI containing plasmid was digested with BsaI (New England Biolabs) and the DNA was gel purified. Specific primers were synthesized (IDT) to generate desired mutants. Briefly, 1 ml of each forward and reverse primer were annealed by heating to 95° C. in TE for 2 min, followed by slow cooling to room temperature. 1 µl of the annealed primers were then ligated with 2 ng of the BsaI digested vector and transformed into E. coli DH5a cell. Mutations were confirmed by DNA sequencing. The ligation reactions can be carried out in a 96-well plate thereby allowing for high-throughput mutagenesis.

For example, Table 8-9 below sets forth primers to generate VH1-46_IGHD6-6*01_IGHJ1*01_APFF CDR2 mutants.

TABLE 8

BsaI restriction enzyme mutagenesis primers

| Primer | Sequence | SEQ ID NO |
|---|---|---|
| VH1-46_C DR1_F | gagacctactatggttcgggtctctgggtgcgacaggcc | 11 |
| VH1-46_C DR2_F | gagacctactatggttcgggtctcaagttccagggcagagtcac | 12 |
| VH1-46_C DR3_F | gagacctactatggttcgggtctctggggcagggcac | 13 |
| VH5-51_C DR1_F | gagacctactatggttcgggtctctgggtgcgccagatg | 14 |
| VH5-51_C DR2_F | gagacctactatggttcgggtctccaggtcaccatctcagccg | 15 |
| VH5-51_C DR3_F | gagacctactatggttcgggtctctggggccaaggaaccc | 16 |
| L6_CDR1_F | gagacctactatggttcgggtctctggtaccaacagaaacctggc | 17 |
| L6_CDR2_F | gagacctactatggttcgggtctcggcatcccagccagg | 18 |
| L6_CDR3_F | gagacctactatggttcgggtctcttcggccaagggacca | 19 |
| V3-4_CDR1_F | gagacctactatggttcgggtctctggtaccagcagaccccca | 20 |
| V3-4_CDR2_F | gagacctactatggttcgggtctcggggtccctgatcgcttc | 21 |
| V3-4_CDR3_F | gagacctactatggttcgggtctcttcggaactgggaccaag | 22 |
| Lambda_BSA_F | gagtggagacgaccacaccc | 23 |
| VH1-46_C DR1_R | GAGACCCGAACCATAGTAGGTCTCAGATGCCTTGCAGGAAACC | 24 |
| VH1-46_C DR2_R | GAGACCCGAACCATAGTAGGTCTCTCCCATCCACTCAAGCCC | 25 |
| VH1-46_C DR3_R | GAGACCCGAACCATAGTAGGTCTCTCTCGCACAGTAATACACGGC | 26 |
| VH5-51_C DR1_R | GAGACCCGAACCATAGTAGGTCTCAGAACCCTTACAGGAGATCTTCA | 27 |
| VH5-51_C DR2_R | GAGACCCGAACCATAGTAGGTCTCCCCCATCCACTCCAGGC | 28 |
| VH5-51_C DR3_R | GAGACCCGAACCATAGTAGGTCTCTCTCGCACAGTAATACATGGC | 29 |
| L6_CDR1_R | GAGACCCGAACCATAGTAGGTCTCGCAGGAGAGGGTGGCTC | 30 |
| L6_CDR2_R | GAGACCCGAACCATAGTAGGTCTCATAGATGAGGAGCCTGGGAG | 31 |
| L6_CDR3_R | GAGACCCGAACCATAGTAGGTCTCACAGTAATAAACTGCAAAATCTTCAG | 32 |

TABLE 8-continued

BsaI restriction enzyme mutagenesis primers

| Primer | Sequence | SEQ ID NO |
|---|---|---|
| V3-4_CDR1_R | GAGACCCGAACCATAGTAGGTCTCACAAGTGAGTGTGACTGTCCCT | 33 |
| V3-4_CDR2_R | GAGACCCGAACCATAGTAGGTCTCGTAGATGAGCGTGCGTGG | 34 |
| V3-4_CDR3_R | GAGACCCGAACCATAGTAGGTCTCACAGTAATAATCAGATTCATCATCTGC | 35 |

TABLE 9

VH1-46_IGHD6-6*01_IGHJ1*01_APFF_CDR2 BsaI mutagenesis primers

| Primer | Sequence | SEQ ID NO |
|---|---|---|
| A_ILPTH_F | tgggaataattctccctactggtcatagcacaagctacgcacaga | 36 |
| A_VLPTH_F | tgggaatagtgctccctactggtcatagcacaagctacgcacaga | 37 |
| A_ALPTH_F | tgggaatagctctccctactggtcatagcacaagctacgcacaga | 38 |
| A_GLPTH_F | tgggaataggcctccctactggtcatagcacaagctacgcacaga | 39 |
| A_TLPTH_F | tgggaataaccctccctactggtcatagcacaagctacgcacaga | 40 |
| A_SLPTH_F | tgggaatatccctccctactggtcatagcacaagctacgcacaga | 41 |
| A_YLPTH_F | tgggaatataccctccctactggtcatagcacaagctacgcacaga | 42 |
| A_WLPTH_F | tgggaatatggctccctactggtcatagcacaagctacgcacaga | 43 |
| A_HLPTH_F | tgggaatacaccctccctactggtcatagcacaagctacgcacaga | 44 |
| A_RLPTH_F | tgggaatacgcctccctactggtcatagcacaagctacgcacaga | 45 |
| A_ELPTH_F | tgggaatagaactccctactggtcatagcacaagctacgcacaga | 46 |
| A_NLPTH_F | tgggaataaacctccctactggtcatagcacaagctacgcacaga | 47 |
| A_TLVTH_F | tgggaataaccctcgtgactggtcatagcacaagctacgcacaga | 48 |
| A_TLATH_F | tgggaataaccctcgctactggtcatagcacaagctacgcacaga | 49 |
| A_TLGTH_F | tgggaataaccctcggcactggtcatagcacaagctacgcacaga | 50 |
| A_TLTTH_F | tgggaataaccctcaccactggtcatagcacaagctacgcacaga | 51 |
| A_TLSTH_F | tgggaataaccctctccactggtcatagcacaagctacgcacaga | 52 |
| A_TLYTH_F | tgggaataaccctctacactggtcatagcacaagctacgcacaga | 53 |
| A_TLWTH_F | tgggaataaccctctggactggtcatagcacaagctacgcacaga | 54 |
| A_TLHTH_F | tgggaataaccctccacactggtcatagcacaagctacgcacaga | 55 |
| A_TLRTH_F | tgggaataaccctccgcactggtcatagcacaagctacgcacaga | 56 |
| A_TLETH_F | tgggaataaccctcgaaactggtcatagcacaagctacgcacaga | 57 |
| A_TLNTH_F | tgggaataaccctcggcactggtcatagcacaagctacgcacaga | 58 |
| A_TLMTH_F | tgggaataaccctcatgactggtcatagcacaagctacgcacaga | 59 |
| A_ILPTH_R | AACTTCTGTGCGTAGCTTGTGCTATGACCAGTAGGGAGAATTATT | 60 |
| A_VLPTH_R | AACTTCTGTGCGTAGCTTGTGCTATGACCAGTAGGGAGCACTATT | 61 |
| A_ALPTH_R | AACTTCTGTGCGTAGCTTGTGCTATGACCAGTAGGGAGAGCTATT | 62 |
| A_GLPTH_R | AACTTCTGTGCGTAGCTTGTGCTATGACCAGTAGGGAGGCCTATT | 63 |
| A_TLPTH_R | AACTTCTGTGCGTAGCTTGTGCTATGACCAGTAGGGAGGGTTATT | 64 |

TABLE 9-continued

VH1-46_IGHD6-6*01_IGHJ1*01_APFF_CDR2_BsaI mutagenesis primers

| Primer | Sequence | SEQ ID NO |
|---|---|---|
| A_SLPTH_R | AACTTCTGTGCGTAGCTTGTGCTATGACCAGTAGGGAGGGATATT | 65 |
| A_YLPTH_R | AACTTCTGTGCGTAGCTTGTGCTATGACCAGTAGGGAGGTATATT | 66 |
| A_WLPTH_R | AACTTCTGTGCGTAGCTTGTGCTATGACCAGTAGGGAGCCATATT | 67 |
| A_HLPTH_R | AACTTCTGTGCGTAGCTTGTGCTATGACCAGTAGGGAGGTGTATT | 68 |
| A_RLPTH_R | AACTTCTGTGCGTAGCTTGTGCTATGACCAGTAGGGAGGCGTATT | 69 |
| A_ELPTH_R | AACTTCTGTGCGTAGCTTGTGCTATGACCAGTAGGGAGTTCTATT | 70 |
| A_NLPTH_R | AACTTCTGTGCGTAGCTTGTGCTATGACCAGTAGGGAGGTTTATT | 71 |
| A_TLVTH_R | AACTTCTGTGCGTAGCTTGTGCTATGACCAGTCACGAGGGTTATT | 72 |
| A_TLATH_R | AACTTCTGTGCGTAGCTTGTGCTATGACCAGTAGCGAGGGTTATT | 73 |
| A_TLGTH_R | AACTTCTGTGCGTAGCTTGTGCTATGACCAGTGCCGAGGGTTATT | 74 |
| A_TLTTH_R | AACTTCTGTGCGTAGCTTGTGCTATGACCAGTGGTGAGGGTTATT | 75 |
| A_TLSTH_R | AACTTCTGTGCGTAGCTTGTGCTATGACCAGTGGAGAGGGTTATT | 76 |
| A_TLYTH_R | AACTTCTGTGCGTAGCTTGTGCTATGACCAGTGTAGAGGGTTATT | 77 |
| A_TLWTH_R | AACTTCTGTGCGTAGCTTGTGCTATGACCAGTCCAGAGGGTTATT | 78 |
| A_TLHTH_R | AACTTCTGTGCGTAGCTTGTGCTATGACCAGTGTGGAGGGTTATT | 79 |
| A_TLRTH_R | AACTTCTGTGCGTAGCTTGTGCTATGACCAGTGCGGAGGGTTATT | 80 |
| A_TLETH_R | AACTTCTGTGCGTAGCTTGTGCTATGACCAGTTTCGAGGGTTATT | 81 |
| A_TLNTH_R | AACTTCTGTGCGTAGCTTGTGCTATGACCAGTGCCGAGGGTTATT | 82 |
| A_TLMTH_R | AACTTCTGTGCGTAGCTTGTGCTATGACCAGTCATGAGGGTTATT | 83 |

Example 2

Cloning and High Throughput Growth and Purification of Fab Libraries

In this Example, Fab antibodies were generated by cloning heavy or light chain variable region DNA into their respective plasmids followed by co-transformation and high throughput protein growth/purification.

A. Cloning and Co-transformation of Variable Heavy and Light Chains

DNA encoding a heavy or light chain variable region was cloned into plasmids containing constant heavy or light chains as appropriate for co-transformation and expression of combinatorial Fabs. Plasmid A (SEQ ID NO:84) and plasmid D (SEQ ID NO:85) contain heavy chain constant regions sequences. Plasmid C (SEQ ID NO:86) contains a kappa light chain constant region sequence and Plasmid E (SEQ ID NO:87) contains a lambda light chain constant region sequence.

DNA encoding a variable heavy chain was digested with Nhe I and Nco I and ligated into Plasmid A with a StII leader sequence using standard molecular techniques. DNA encoding a variable kappa light chain was digested with NcoI and BsiWI and DNA encoding a variable lambda chain was digested with NcoI and AvrII, and were ligated into Plasmid C or Plasmid E, respectively, with a StII leader sequence, using standard molecular biology techniques.

Plasmid A and one of either Plasmid C or Plasmid E, each containing various combinations of variable heavy and light chains, were co-transformed into E. coli. The process was repeated for all combinations of heavy and light chains. Briefly, plasmid A (encoding a Fab heavy chain) and plasmid C or Plasmid E (encoding a Fab light chain) were resuspended separately in TE buffer to a final concentration of 1 ng/µl. One (1)µL of heavy chain plasmid and 1 µL of light chain plasmid were combined in a PCR tube or a PCR plate and were mixed with 20 µL ice cold LMG194 competent cells. The transformation reaction was incubated on ice for 10 minutes followed by heat shock in a preheated PCR block at 42° C. for 45 seconds. The tube was then placed on ice for an additional 2 minutes followed by addition of 200 µL SOC medium. The cells were allowed to recover for 1.5 hours at 37° C. A 100 µL aliquot of the transformation culture was used to inoculate 0.9 mL LB (Luria-Bertani Broth) containing 0.4% (w/v) glucose, 17 µg/mL kanamycin (Sigma Aldrich) and 34 µg/mL chloramphenicol (Sigma Aldrich). The culture was grown at 30° C. with vigorous shaking for 20 hours. The transformation culture was grown and purified using the Piccolo™ system as described below.

B. High Throughput Growth and Purification of Fab Antibodies

Following transformation, the cells were grown overnight in 2 ml deep well 96-well plates (VWR) block covered with breathable tape. The overnight culture was used directly for inoculation in Piccolo™ (Wollerton et al. (2006) JALA, 11:291-303.)

High throughput, parallel expression and purification of Fab antibodies was performed using Piccolo™ (The Automation Partnership (TAP)), which automates protein expression and purification. The expression and purification parameters for Piccolo™ were prepared using Run Composer software (TAP). A 'Strain File' was generated mapping the location of each clone in the seed culture plate. This was submitted to the Run Composer software and the basic machine settings were set as follows: Pre-induction Incubator set at 30° C.; Expression Incubator 1 set at 16° C.; Centrifuge set at 6° C. and 5000×g; Media Pump 1 primed with TB (Terrific Broth; per liter contains 12 g tryptone, 24 g yeast extract, 9.4 g potassium phosphate, dibasic, and 2.2 g potassium phosphate, monobasic) (EMD Biosciences; catalog No. 71754), 50 µg/mL kanamycin (Sigma Aldrich), 35 µg/mL chloramphenicol (Sigma Aldrich), 0.4% (w/v) glucose (Sigma Aldrich) and 0.015% (v/v) Antifoam 204 (Sigma Aldrich); Inducer Pump 1 primed with 0.2% (w/v) arabinose (EMD Biosciences); Incubator Gassing Rate set at 2 sec with 51% oxygen, 0.1 mL inoculation volume; Induction Statistic Mean set w/o Outliers (i.e. block mean $OD_{600}$ determined after excluding the 3 highest and 3 lowest values); culture vessel blocks (CVB) pre-induction delay set at 1 hr 20 min and Expression Incubator Acclimatization set at 30 min.

The seed cultures were prepared and loaded into Piccolo™ along with the necessary labware: 24-well culture vessel blocks (CVBs; The Automation Partnership), 24-well Filter Plates (The Automation Partnership), 24-well Output Plates (Seahorse Bioscience) and Pipette Tip Boxes (MBP) as specified by the manufacturer. The TB media supplemented as described above, arabinose inducer and associated pumps were prepared under sterile conditions and attached to the machine. The centrifuge counterbalance weight was set and placed inside the centrifuge. Lastly, purification reagents were prepared and attached to the system pumps (lysis buffer, resin, wash buffer and elution buffer as described below). Once this was complete, the machine was started and processing began.

Before inoculation, the inocula were mapped to specific wells of 24-well CVB, and expression and induction conditions were set as described below. Each well of the CVBs was filled with 10 mL of TB media supplemented as described above prior to inoculation from the seed plate. Each well of each CVB was inoculated with 0.1 mL seed culture and then returned to the storage carousel to await scheduled admission to pre-induction incubation. Once a CVB was queued to begin pre-induction incubation it was removed from the storage carousel and coupled to an aeration assembly (which provides agitation, well sealing and a means for controlled administration of oxygen/air) and then placed in the pre-induction incubator set at 30° C. $OD_{600}$ readings were taken upon commencement of incubation and approximately every 30 minutes thereafter. Piccolo operation control software monitors the $OD_{600}$ measurements to predict when each CVB will reach the 1.0 $OD_{600}$ set point. Approximately 30 minutes prior to the CVB reaching the $OD_{600}$ set point the assembly was moved to the expression incubator to equilibrate to the expression temperature of 20° C., and then the cultures in the CVB were induced by addition of 0.032% arabinose inducer followed by 45 hours of expression.

Following culture inoculation and growth induction of cultures, the cells were harvested and lysed for purification of Fabs. Piccolo™ was used for purification of the expressed Fab proteins using an automated expression and purification 'Lifecycle' of a whole culture purification. After controlled expression, CVBs were chilled for 30 minutes at 6° C. in the storage carousel prior to lysis. The CVB was moved to the liquid handling bed and lysis buffer (2.5 mL of Popculture with 1:1000 Lysonase (EMD Biosciences)) was added to each well with thorough mixing. The lysis proceeded for 10 minutes and then the CVB was centrifuged for 10 minutes at 5000×g to pellet cell debris. During centrifugation, a Filter Plate was placed in the filter bed and resin (2 mL of a 50% slurry of Ni-charged His-Bind resin (EMD Biosciences)) was added to each well. Soluble lysate was added to the corresponding wells of the filter plate containing resin and allowed to bind for 10 minutes prior to draining to waste. Wash buffer (12 mL of wash buffer (50 mM Sodium Phosphate, 300 mM NaCl, 30 mM Imidazole, pH 8.0)) was added in two steps to each well and allowed to drain to waste. Finally, an Output Plate was placed under the Filter Plate in the filter bed and IMAC elution buffer (50 mM Sodium Phosphate, 300 mM NaCl, 500 mM Imidazole) was added in two steps draining into the output plate. The output plate was returned to the storage carousel as was all other labware. Once this process was complete for each CVB in the designed run, the machine was unloaded.

Example 3

Orthogonal Secondary Purification of Fab Antibodies

To rapidly further purify partially pure Fabs generated after the Piccolo™ process, an orthogonal method of purification was developed. Fabs were expressed and purified as described above in Example 2 using the Piccolo™ machine.

Two different affinity resins were used depending on the light chain classes. Fabs with a kappa light chain were further purified on Protein G column (GE Healthcare), and Fabs with a lambda light chain were further purified on CaptureSelect Fab Lambda affinity column (BAC, Netherlands). First, the protein samples were transferred to a deep well 96-well block (VWR). Approximately 1.8 mL of the IMAC elution per Fab sample was purified on either a 1 mL Hi-Trap Protein G column or a 0.5 mL CaptureSelect Fab Lambda affinity column at 4° C. using the Akta purifier (GE Healthcare) and A-905 autosampler (GE Healthcare) according to the manufacturer's protocol. Protein concentration was determined by measuring absorbance at A280 on a Molecular Dynamic plate reader and calculated from the exctinction coefficient of the corresponding Fab. Extinction coefficients are calculated based on the total numbers of Tyrosine+Tryptophane+Phenylalanine in the Fab heavy and light chains. Following purification using the Piccolo™ system, expressed protein was generally less than 20% pure. After orthogonal purification with protein G, Fab purity was greater than 95% pure as indicated by SDS-PAGE.

Example 4

Electrochemiluminescence Binding Assay

In this example, an electrochemiluminescence (ECL) binding assay was used to screen a Fab library (e.g. see Table 4) for antibodies capable of binding to one of nine different antigens, including the human epidermal growth factor 2 receptor (ErbB2), epidermal growth factor receptor (EGF R), hepatocyte growth factor receptor (HGF R/c-Met), Notch-1, CD44, insulin-like growth factor-1 soluble receptor (IGF-1 sR), P-cadherin, erythropoietin receptor (Epo R) and delta-like protein 4 (DLL4). In an ECL assay, an antigen-antibody interaction is detected by addition of a detection antibody labeled with ruthenium tri-bispyridine-(4-methysulfone) (Ru(bpy)$_2^{2+}$). Upon application of an electric current, the Ru(bpy)$_2^{2+}$-label undergoes an oxidation-reduction cycle in the presence of a co-reactant and light is emitted. A signal is only generated when the Ru(bpy)$_2^{2+}$-label is in close proximity to the electrode, eliminating the need for washing. Detected light intensity is proportional to the amount of captured protein.

Recombinant human proteins were obtained from R&D Systems and included: rHuman ErbB2/Fc Chimera, CF (Cat#1129-ER); rHuman EGF R/Fc Chimera, CF (Cat#344-ER); rHuman HGF R/c-MET/Fc Chimera, CF (Cat#358-MT/CF); rHuman Notch-1/Fc Chimera, CF (Cat#3647-TK); rHuman CD44/Fc Chimera, CF (Cat#3660-CD); rHuman IGF-1 sR, (IGF-1 sR), CF (Cat#391-GR); rHuman P-Cadherin/Fc Chimera, CF (Cat#861-PC); rHuman Erythropoietin R/Fc Chimera, CF (Cat#963-ER); and Recombinant Human DLL4 (Cat#1506-D4/CF).

A. Multispot ECL Assay for Binding to Multiple Antigens

Each of the antigens listed above were immobilized onto each well of 10 plates by spotting 50 nanoliters (nl) of each protein (of a 60 µg/mL antigen) on the surface of a 96-well Multi-Spot 10 Highbind plate (Meso Scale Discovery; Gaithersburg Md.). Spot 10 was left blank as a control.

An 150 µl aliquot of 1% Bovine Serum Albumin (BSA) in Tris-buffered Saline Tween (TBST) was added to each well and allowed to incubate for 30 min at 20° C. followed by washing and tap drying to completely remove any residual solution. Subsequently, a 12.5 µl aliquot of 1% BSA TBST was added to each well followed by the addition of a 12.5 µl aliquot of a purified Fab. The plate was sealed and incubated for 1 hour at 20° C. with shaking.

Detection antibodies were prepared by individually conjugating both goat anti-human Kappa light chain polyclonal antibody (K3502-1MG, Sigma-Aldrich) and goat anti-human Lambda light chain polyclonal antibody (L1645-1ML, Sigma-Aldrich) with Ruthenium (II) tris-bipyridine-(4-methylsulfone)-N-hydroxysuccinimide (SULFO-TAG NHS-ester, Meso Scale Discovery) according to the manufacturer's instructions. TAG-detection antibody at 25 ml was added to each well and allowed to incubate for 1 hour at 20° C. with shaking. Finally, 15 µl of Read Buffer P with Surfactant (Cat # R92PC-1, Meso Scale Discovery) was added to each well. The electrochemiluminescence was measured using a Sector Imager 2400 (Meso Scale Discovery). Data was analyzed by comparing the ECL signals for an antigen to the blank of each well. A signal to blank ratio of 4 or more was considered a "Hit" Fab.

Using the Multispot ECL assay antibodies were identified that bind to the selected antigens. Table 10, below, lists the Fabs (including the heavy chain and light chain) that were identified as "hits" using the Multispot ECL assay and the target(s) of the identified Fab "hit." Several Fabs were identified that bind to multiple targets. For example, VH1-46_IGHD6-13*01_IGH41*01 & B3_IGKJ1*01, shows affinity for both Human ErbB2/Fc and Human Erythropoietin R/Fc chimeras; Fab VH1-46_IGHD2-15*01_IGHJ2*01 & L12_IGKJ1*01 binds to EGF R, Epo R and DLL4 and Fab VH1-46_IGHD3-10*01_IGHJ4*01 & L12_IGKJ1*01 binds to Notch-1, P-cadherin and DLL4.

TABLE 10

IDENTIFIED FAB "HITS"

| Target | Heavy Chain | SEQ ID NO | Light Chain | SEQ ID NO |
|---|---|---|---|---|
| rHuman DLL4 | VH1-46_IGHD6-6*01_IGHJ1*01 | 88 | L6_IGKJ1*01 | 107 |
| rHuman DLL4 | VH5-51_IGHD5-18*01 > 3_IGHJ4*01 | 89 | V3-4_IGLJ1*01 | 108 |
| rHuman DLL4 | VH6-1_IGHD3-3*01_IGHJ4*01 | 90 | V4-3_IGLJ4*01 | 109 |
| rHuman ErbB2/Fc chimera | VH4-31_IGHD1-26*01_IGHJ2*01 | 91 | A27_IGKJ1*01 | 110 |
| rHuman Epo R/Fc chimera | VH1-46_IGHD3-10*01_IGHJ4*01 | 92 | B3_IGKJ1*01 | 111 |
| rHuman ErbB2/Fc chimera and rHuman Epo R/Fc chimera | VH1-46_IGHD6-13*01_IGHJ4*01 | 93 | B3_IGKJ1*01 | 111 |
| Epo R/Fc chimera | VH4-28_IGHD7-27*01_IGHJ1*01 | 94 | L2_IGKJ1*01 | 112 |
| Epo R/Fc chimera | VH4-31_IGHD7-27*01_IGHJ5*01 | 95 | L2_IGKJ1*01 | 112 |
| ErbB2/Fc chimera | VH2-5_IGHD7-27*01_IGHJ2*01 | 96 | L2_IGKJ1*01 | 112 |
| Epo R/Fc chimera | VH1-46_IGHD7-27*01_IGHJ2*01 | 97 | A27_IGKJ1*01 | 110 |
| ErbB2/Fc chimera | VH1-69_IGHD1-1*01_IGHJ6*01 | 98 | A17_IGKJ1*01 | 113 |
| Epo R/Fc chimera and EGF R/Fc chimera | VH1-46_IGHD2-15*01_IGHJ2*01 | 99 | L2_IGKJ1*01 | 112 |
| EGF R/Fc chimera, Notch-1/Fc chimera, P-cadherin/Fc chimera, Epo R/Fc chimera and DLL4 | VH1-46_IGHD6-13*01_IGHJ4*01 | 93 | L2_IGKJ1*01 | 112 |
| DLL4 | VH4-34_IGHD7-27*01_IGHJ4*01 | 100 | L5_IGKJ1*01 | 114 |
| Notch-1/Fc chimera, P-cadherin/Fc chimera, Epo R/Fc chimera and DLL4 | VH1-46_IGHD6-13*01_IGHJ4*01 | 93 | A27_IGKJ1*01 | 110 |
| P-cadherin/Fc chimera | VH1-46_IGHD7-27*01_IGHJ2*01 | 97 | L6_IGKJ1*01 | 107 |
| DLL4 | VH1-3_IGHD4-23*01_IGHJ4*01 | 101 | L12_IGKJ1*01 | 115 |

TABLE 10-continued

IDENTIFIED FAB "HITS"

| Target | Heavy Chain | SEQ ID NO | Light Chain | SEQ ID NO |
|---|---|---|---|---|
| EGF R/Fc chimera, Epo R/Fc chimera and DLL4 | VH1-46_IGHD2-15*01_IGHJ2*01 | 99 | L12_IGKJ1*01 | 115 |
| Notch-1/Fc chimera, P-cadherin/Fc chimera and DLL4 | VH1-46_IGHD3-10*01_IGHJ4*01 | 92 | L12_IGKJ1*01 | 115 |
| DLL4 | VH1-8_IGHD2-2*01_IGHJ6*01 | 102 | L12_IGKJ1*01 | 115 |
| Epo R/Fc chimera | VH1-46_IGHD3-10*01_IGHJ4*01 | 92 | O1_IGKJ1*01 | 116 |
| Epo R/Fc chimera and DLL4 | VH1-46_IGHD6-13*01_IGHJ4*01 | 93 | O1_IGKJ1*01 | 116 |
| DLL4 | VH4-34_IGHD7-27*01_IGHJ4*01 | 100 | V1-4_IGLJ4*01 | 117 |
| DLL4 | VH4-31_IGHD2-15*01_IGHJ2*01 | 103 | V1-4_IGLJ4*01 | 117 |
| DLL4 | VH4-34_IGHD7-27*01_IGHJ4*01 | 100 | V4-6_IGLJ4*01 | 118 |
| P-cadherin/Fc chimera and Epo R/Fc chimera | VH3-23_IGHD3-10*01 > 3_IGHJ6*01 | 104 | O12_IGKJ1*01 | 119 |
| P-cadherin/Fc chimera | VH3-23_IGHD3-10*01 > 1'_IGHJ3*01 | 105 | O12_IGKJ1*01 | 119 |

To confirm a "Hit" from the initial Multispot ECL screening, a Fab concentration dependent titration was carried out to determine the Fab-antigen binding affinity. The Multispot ECL assay procedure was the same as described above, except that the concentration of Fab antibody was varied between wells from 0.1 nM to 2.4 µM as indicated in the Tables below depending on each Fab tested. The data are set forth in Tables 11-33 below.

TABLE 11

Binding affinity of Fab VH1-46_IGHD6-6*01_IGHJ1*01 & L6_IGKJ1*01

| Fab[nM] | 2383 | 595.8 | 148.9 | 37.2 | 9.3 | 2.3 | 0.6 | 0.1 |
|---|---|---|---|---|---|---|---|---|
| ErbB2/Fc | 454 | 321 | 247 | 384 | 354 | 291 | 215 | 306 |
| EGF R/Fc | 621 | 403 | 290 | 228 | 424 | 289 | 309 | 311 |
| HGF R/Fc | 762 | 353 | 205 | 207 | 324 | 253 | 256 | 286 |
| Notch-1/Fc | 690 | 306 | 375 | 402 | 492 | 333 | 337 | 378 |
| CD44/Fc | 559 | 372 | 348 | 356 | 396 | 317 | 238 | 323 |
| IGF-1 sR | 527 | 335 | 322 | 295 | 315 | 231 | 313 | 241 |
| P-Cadherin/Fc | 728 | 617 | 687 | 649 | 452 | 401 | 321 | 235 |
| EPO R/Fc | 658 | 378 | 373 | 315 | 306 | 429 | 337 | 373 |
| DLL4 | 11794 | 17203 | 16253 | 16717 | 13210 | 3055 | 508 | 317 |
| Blank | 344 | 285 | 218 | 199 | 287 | 234 | 226 | 201 |

TABLE 12

Binding affinity of Fab VH5-51_IGHD5-18*01 > 3_IGHJ4*01 & V3-4_IGLJ1*01

| Fab [nM] | 154 | 51 | 17 | 6 |
|---|---|---|---|---|
| ErbB2/Fc | 1593 | 1248 | 1033 | 873 |
| EGF R/Fc | 1398 | 816 | 805 | 742 |
| HGF R/Fc | 1520 | 1044 | 914 | 831 |
| Notch-1/Fc | 929 | 685 | 558 | 464 |
| CD44/Fc | 960 | 651 | 518 | 547 |
| IGF-1 sR | 1396 | 1051 | 872 | 854 |
| P-Cadherin/Fc | 1733 | 854 | 542 | 358 |
| EPO R/Fc | 1195 | 750 | 620 | 548 |
| DLL4 | 40392 | 17025 | 7158 | 1946 |
| Blank | 447 | 335 | 143 | 191 |

TABLE 13

Binding affinity of Fab VH6-1_IGHD3-3*01_IGHJ4*01 & V4-3_IGLJ4*01

| Fab[nM] | 480 | 240 | 120 | 60 | 30 | 15 | 7.5 | 3.8 |
|---|---|---|---|---|---|---|---|---|
| ErbB2/Fc | 965 | 833 | 822 | 777 | 726 | 713 | 695 | 714 |
| EGF R/Fc | 877 | 690 | 658 | 679 | 585 | 584 | 582 | 511 |
| HGF R/Fc | 951 | 834 | 785 | 623 | 640 | 694 | 558 | 519 |
| Notch-1/Fc | 545 | 368 | 472 | 415 | 425 | 508 | 392 | 383 |
| CD44/Fc | 541 | 470 | 442 | 434 | 484 | 454 | 444 | 419 |
| IGF-1 sR | 741 | 625 | 813 | 654 | 697 | 705 | 642 | 463 |
| P-Cadherin/Fc | 596 | 383 | 450 | 372 | 440 | 351 | 352 | 281 |
| EPO R/Fc | 621 | 478 | 431 | 423 | 325 | 397 | 443 | 407 |
| DLL4 | 1532 | 1273 | 938 | 875 | 736 | 690 | 598 | 462 |
| Blank | 362 | 316 | 363 | 237 | 213 | 261 | 217 | 198 |

TABLE 14

Binding affinity of Fab VH4-31_IGHD1-26*01_IGHJ2*01 & A27_IGKJ1*01

| Fab[nM] | 410 | 205 | 102.5 | 51.3 | 25.6 | 12.8 | 6.4 | 3.2 |
|---|---|---|---|---|---|---|---|---|
| ErbB2/Fc | 5422 | 5260 | 4355 | 3588 | 2992 | 2255 | 1796 | 868 |
| EGF R/Fc | 734 | 595 | 455 | 379 | 373 | 320 | 249 | 254 |
| HGF R/Fc | 753 | 735 | 425 | 456 | 382 | 258 | 234 | 294 |
| Notch-1/Fc | 804 | 722 | 607 | 408 | 270 | 249 | 279 | 275 |
| CD44/Fc | 767 | 613 | 461 | 409 | 332 | 273 | 240 | 295 |
| IGF-1 sR | 600 | 565 | 443 | 316 | 311 | 323 | 209 | 313 |
| P-Cadherin/Fc | 814 | 769 | 714 | 424 | 323 | 245 | 197 | 206 |
| EPO R/Fc | 797 | 595 | 587 | 498 | 409 | 338 | 264 | 233 |
| DLL4 | 859 | 599 | 550 | 474 | 384 | 268 | 256 | 242 |
| Blank | 637 | 430 | 437 | 337 | 345 | 227 | 133 | 172 |

TABLE 15

Binding affinity of Fab VH1-46_IGHD3-10*01_IGHJ4*01 & B3_IGKJ1*01

| Fab[nM] | 1410 | 705 | 352.5 | 176.3 | 88.1 | 44.1 | 22 | 11 |
|---|---|---|---|---|---|---|---|---|
| ErbB2/Fc | 932 | 671 | 514 | 448 | 200 | 347 | 363 | 216 |
| EGF R/Fc | 1071 | 692 | 769 | 428 | 376 | 428 | 312 | 201 |
| HGF R/Fc | 903 | 839 | 606 | 418 | 392 | 336 | 203 | 268 |
| Notch-1/Fc | 1034 | 958 | 715 | 664 | 440 | 331 | 389 | 404 |
| CD44/Fc | 885 | 693 | 556 | 376 | 340 | 302 | 317 | 296 |
| IGF-1 sR | 426 | 630 | 528 | 393 | 273 | 309 | 347 | 289 |
| P-Cadherin/Fc | 1059 | 827 | 649 | 532 | 278 | 343 | 215 | 270 |
| EPO R/Fc | 4314 | 4894 | 4105 | 3519 | 3368 | 2387 | 2241 | 1824 |
| DLL4 | 1265 | 981 | 660 | 460 | 434 | 388 | 342 | 254 |
| Blank | 709 | 483 | 494 | 346 | 301 | 200 | 289 | 212 |

TABLE 16

Binding affinity of Fab VH1-46_IGHD6-13*01_IGHJ4*01 & B3_IGKJ1*01

| Fab[nM] | 1000 | 500 | 250 | 125 | 62.5 | 31.3 | 15.6 | 7.8 |
|---|---|---|---|---|---|---|---|---|
| ErbB2/Fc | 8731 | 10241 | 11026 | 12956 | 13124 | 13911 | 14791 | 13220 |
| EGF R/Fc | 2236 | 1468 | 1138 | 860 | 602 | 447 | 346 | 379 |
| HGF R/Fc | 2109 | 1371 | 1221 | 778 | 578 | 299 | 293 | 282 |
| Notch-1/Fc | 2267 | 1975 | 1241 | 802 | 536 | 563 | 418 | 486 |
| CD44/Fc | 1966 | 1685 | 1175 | 764 | 591 | 439 | 473 | 409 |
| IGF-1 sR | 1667 | 1334 | 993 | 654 | 491 | 385 | 349 | 353 |
| P-Cadherin/Fc | 4495 | 3447 | 2784 | 1481 | 1173 | 1105 | 971 | 695 |
| EPO R/Fc | 8594 | 10305 | 8535 | 9237 | 7749 | 7878 | 8357 | 6765 |
| DLL4 | 2785 | 2319 | 1560 | 912 | 715 | 528 | 525 | 407 |
| Blank | 1133 | 680 | 590 | 403 | 268 | 250 | 294 | 316 |

TABLE 17

Binding affinity of Fab VH4-28_IGHD7-27*01_IGHJ1*01 & L2_IGKJ1*01

| Fab [nM] | 360 | 36 |
|---|---|---|
| ErbB2/Fc | 647 | 600 |
| EGF R/Fc | 957 | 711 |
| HGF R/Fc | 581 | 613 |
| Notch-1/Fc | 1026 | 773 |
| CD44/Fc | 740 | 679 |
| IGF-1 sR | 535 | 486 |
| P-Cadherin/Fc | 636 | 693 |
| EPO R/Fc | 4715 | 2977 |
| DLL4 | 866 | 799 |
| Blank | 462 | 413 |

TABLE 18

Binding affinity of Fab VH1-46_IGHD2-15*01_IGHJ2*01 & L2_IGKJ1*01

| Fab [µM] | 0.25 | 0.0625 | 0.01563 | 0.00391 |
|---|---|---|---|---|
| ErbB2/Fc | 29608 | 9033 | 4495 | 1667 |
| EGF R/Fc | 116674 | 94778 | 70836 | 35936 |
| HGF R/Fc | 13427 | 4108 | 1998 | 913 |
| Notch-1/Fc | 21447 | 5848 | 2800 | 1282 |
| CD44/Fc | 23015 | 6746 | 3182 | 1295 |
| IGF-1 sR | 11050 | 3150 | 1742 | 822 |
| P-Cadherin/Fc | 25459 | 7739 | 4945 | 1962 |
| EPO R/Fc | 49177 | 21136 | 11342 | 5022 |
| DLL4 | 27691 | 8051 | 4015 | 1551 |
| Blank | 6344 | 1738 | 906 | 576 |

TABLE 19

Binding affinity of Fab VH1-46_IGHD6-13*01_IGHJ4*01 & L2_IGKJ1*01

| Fab [µM] | 1.19 | 0.2975 | 0.07438 | 0.01859 |
|---|---|---|---|---|
| ErbB2/Fc | 38410 | 15111 | 7551 | 5531 |
| EGF R/Fc | 62454 | 42213 | 16605 | 11750 |
| HGF R/Fc | 45494 | 17396 | 6611 | 4566 |
| Notch-1/Fc | 72018 | 37503 | 21990 | 17565 |
| CD44/Fc | 47145 | 28601 | 10922 | 7322 |
| IGF-1 sR | 35187 | 17389 | 5804 | 3779 |
| P-Cadherin/Fc | 69710 | 26043 | 14807 | 11672 |
| EPO R/Fc | 192967 | 167064 | 153692 | 188065 |
| DLL4 | 74900 | 34726 | 20719 | 18888 |
| Blank | 24999 | 5019 | 2504 | 1776 |

TABLE 20

Binding affinity of Fab VH4-34_IGHD7-27*01_IGHJ4*01 & L5_IGKJ1*01

| Fab [µM] | 0.51 | 0.1275 | 0.03188 | 0.00797 |
|---|---|---|---|---|
| ErbB2/Fc | 1532 | 857 | 584 | 493 |
| EGF R/Fc | 2363 | 1061 | 694 | 530 |
| HGF R/Fc | 1989 | 853 | 693 | 419 |
| Notch-1/Fc | 2773 | 1497 | 849 | 654 |
| CD44/Fc | 2012 | 926 | 653 | 490 |
| IGF-1 sR | 2236 | 1045 | 765 | 564 |
| P-Cadherin/Fc | 2389 | 957 | 775 | 502 |
| EPO R/Fc | 2624 | 1067 | 789 | 566 |
| DLL4 | 5183 | 2382 | 1282 | 872 |
| Blank | 1096 | 530 | 536 | 364 |

TABLE 21

Binding affinity of Fab VH1-46_IGHD6-13*01_IGHJ4*01 & A27_IGKJ1*01

| Fab [µM] | 0.48 | 0.096 | 0.0192 |
|---|---|---|---|
| ErbB2/Fc | 11287 | 3365 | 2313 |
| EGF R/Fc | 14638 | 4509 | 3115 |
| HGF R/Fc | 8002 | 2328 | 1582 |
| Notch-1/Fc | 15931 | 4802 | 3041 |
| CD44/Fc | 13445 | 4320 | 2915 |
| IGF-1 sR | 8927 | 2449 | 1826 |
| P-Cadherin/Fc | 15595 | 6654 | 5040 |
| EPO R/Fc | 70938 | 57356 | 62037 |
| DLL4 | 16065 | 5586 | 3555 |
| Blank | 2945 | 917 | 751 |

TABLE 22

Binding affinity of Fab VH1-46_IGHD7-27*01_IGHJ2*01 & L6_IGKJ1*01

| Fab [µM] | 1.56 | 0.312 | 0.0624 |
|---|---|---|---|
| ErbB2/Fc | 7577 | 3659 | 2146 |
| EGF R/Fc | 7832 | 4328 | 2415 |
| HGF R/Fc | 10267 | 4691 | 2453 |
| Notch-1/Fc | 9447 | 4462 | 2352 |
| CD44/Fc | 7595 | 4171 | 2110 |
| IGF-1 sR | 6913 | 3508 | 2034 |
| P-Cadherin/Fc | 15016 | 7098 | 4226 |
| EPO R/Fc | 9480 | 5020 | 2678 |
| DLL4 | 10897 | 5484 | 2585 |
| Blank | 4357 | 1977 | 960 |

TABLE 23

Binding affinity of Fab VH1-3_IGHD4-23*01_IGHJ4*01 & L12_IGKJ1*01

| Fab [nM] | 60 | 15 | 3.75 | 0.9375 |
|---|---|---|---|---|
| ErbB2/Fc | 2155 | 740 | 291 | 268 |
| EGF R/Fc | 2563 | 842 | 371 | 224 |
| HGF R/Fc | 2298 | 743 | 394 | 243 |
| Notch-1/Fc | 2886 | 1058 | 375 | 348 |
| CD44/Fc | 2355 | 748 | 307 | 251 |
| IGF-1 sR | 2666 | 859 | 314 | 204 |
| P-Cadherin/Fc | 2662 | 837 | 331 | 191 |
| EPO R/Fc | 3214 | 970 | 358 | 238 |
| DLL4 | 17270 | 7728 | 1569 | 453 |
| Blank | 1433 | 536 | 191 | 153 |

TABLE 24

Binding affinity of Fab VH1-46_IGHD2-15*01_IGHJ2*01 & L12_IGKJ1*01

| Fab [nM] | 280 | 70 | 17.5 | 4.375 |
|---|---|---|---|---|
| ErbB2/Fc | 3953 | 1358 | 541 | 384 |
| EGF R/Fc | 6667 | 2574 | 1305 | 542 |
| HGF R/Fc | 3564 | 1289 | 565 | 193 |
| Notch-1/Fc | 4382 | 1492 | 680 | 480 |
| CD44/Fc | 4069 | 1370 | 664 | 424 |
| IGF-1 sR | 3533 | 1319 | 626 | 369 |
| P-Cadherin/Fc | 5400 | 1817 | 949 | 469 |
| EPO R/Fc | 8496 | 2485 | 1262 | 594 |
| DLL4 | 8111 | 2747 | 1219 | 558 |
| Blank | 1691 | 635 | 304 | 305 |

TABLE 25

Binding affinity of Fab VH1-46_IGHD3-10*01_IGHJ4*01 & L12_IGKJ1*01

| Fab [nM] | 920 | 230 | 57.5 | 14.375 |
|---|---|---|---|---|
| ErbB2/Fc | 10924 | 4078 | 2447 | 1594 |
| EGF R/Fc | 13406 | 5723 | 3858 | 2672 |
| HGF R/Fc | 10708 | 3934 | 2297 | 1600 |
| Notch-1/Fc | 20086 | 9737 | 5886 | 4206 |
| CD44/Fc | 9698 | 3817 | 2313 | 1488 |
| IGF-1 sR | 10246 | 4764 | 2833 | 1746 |
| P-Cadherin/Fc | 16666 | 6484 | 4110 | 2318 |
| EPO R/Fc | 16429 | 6949 | 4038 | 2718 |
| DLL4 | 73638 | 119436 | 144126 | 125422 |
| Blank | 4082 | 1656 | 954 | 738 |

TABLE 26

Binding affinity of Fab VH1-8_IGHD2-2*01_IGHJ6*01 & L12_IGKJ1*01

| | Fab [nM] | | | |
|---|---|---|---|---|
| | 130 | 32.5 | 8.1 | 2.0 |
| ErbB2/Fc | 1533 | 556 | 557 | 382 |
| EGF R/Fc | 1746 | 645 | 560 | 424 |
| HGF R/Fc | 1882 | 525 | 551 | 356 |
| Notch-1/Fc | 1759 | 706 | 612 | 539 |
| CD44/Fc | 1754 | 573 | 528 | 447 |
| IGF-1 sR | 1973 | 561 | 518 | 367 |
| P-Cadherin/Fc | 1845 | 556 | 573 | 250 |
| EPO R/Fc | 2151 | 673 | 660 | 433 |
| DLL4 | 7738 | 2989 | 1548 | 605 |
| Blank | 1153 | 473 | 435 | 316 |

TABLE 27

Binding affinity of Fab FabVH1-46_IGHD3-10*01_IGHJ4*01 & O1_IGKJ1*01

| | Fab [nM] | | | |
|---|---|---|---|---|
| | 1570 | 392.5 | 98.1 | 24.5 |
| ErbB2/Fc | 1263 | 539 | 247 | 241 |
| EGF R/Fc | 2481 | 744 | 4386 | 317 |
| HGF R/Fc | 1638 | 581 | 335 | 211 |
| Notch-1/Fc | 1639 | 749 | 313 | 434 |
| CD44/Fc | 1381 | 498 | 265 | 267 |
| IGF-1 sR | 1428 | 466 | 309 | 239 |
| P-Cadherin/Fc | 1793 | 459 | 347 | 257 |
| EPO R/Fc | 6121 | 5863 | 5628 | 4531 |
| DLL4 | 2701 | 735 | 402 | 339 |
| Blank | 866 | 338 | 210 | 149 |

TABLE 28

Binding affinity of Fab VH1-46_IGHD6-13*01_IGHJ4*01 & O1_IGKJ1*01

| | Fab [nM] | | | |
|---|---|---|---|---|
| | 930 | 232.5 | 58.1 | 14.5 |
| ErbB2/Fc | 2225 | 779 | 322 | 274 |
| EGF R/Fc | 3110 | 803 | 444 | 357 |
| HGF R/Fc | 2344 | 790 | 432 | 373 |
| Notch-1/Fc | 2206 | 778 | 388 | 317 |
| CD44/Fc | 1917 | 607 | 375 | 212 |
| IGF-1 sR | 1915 | 569 | 343 | 234 |
| P-Cadherin/Fc | 2438 | 655 | 478 | 277 |
| EPO R/Fc | 3009 | 1472 | 829 | 660 |

TABLE 28-continued

Binding affinity of Fab VH1-46_IGHD6-13*01_IGHJ4*01 & O1_IGKJ1*01

| | Fab [nM] | | | |
|---|---|---|---|---|
| | 930 | 232.5 | 58.1 | 14.5 |
| DLL4 | 8162 | 3586 | 1876 | 1149 |
| Blank | 1206 | 460 | 225 | 117 |

TABLE 29

Binding affinity of Fab VH4-34_IGHD7-27*01_IGHJ4*01 & V1-4_IGLJ4*01

| | Fab [nM] | | | |
|---|---|---|---|---|
| | 580 | 145 | 36.3 | 9.1 |
| ErbB2/Fc | 1712 | 1123 | 1029 | 987 |
| EGF R/Fc | 1631 | 856 | 831 | 800 |
| HGF R/Fc | 2341 | 1173 | 1065 | 894 |
| Notch-1/Fc | 1585 | 860 | 633 | 754 |
| CD44/Fc | 1228 | 692 | 629 | 607 |
| IGF-1 sR | 1364 | 794 | 799 | 788 |
| P-Cadherin/Fc | 2240 | 850 | 684 | 589 |
| EPO R/Fc | 1579 | 845 | 722 | 697 |
| DLL4 | 4420 | 2140 | 1399 | 1030 |
| Blank | 679 | 357 | 314 | 276 |

TABLE 30

Binding affinity of Fab VH4-31_IGHD2-15*01_IGHJ2*01 & V1-4_IGLJ4*01

| | Fab [nM] | | | |
|---|---|---|---|---|
| | 210 | 52.5 | 13.1 | 3.3 |
| ErbB2/Fc | 1977 | 1511 | 930 | 1031 |
| EGF R/Fc | 1617 | 1109 | 824 | 847 |
| HGF R/Fc | 2060 | 1286 | 981 | 849 |
| Notch-1/Fc | 1972 | 1323 | 669 | 726 |
| CD44/Fc | 1395 | 897 | 708 | 621 |
| IGF-1 sR | 1431 | 911 | 814 | 743 |
| P-Cadherin/Fc | 4410 | 2161 | 1062 | 678 |
| EPO R/Fc | 2123 | 1319 | 776 | 695 |
| DLL4 | 4108 | 1951 | 1107 | 922 |
| Blank | 833 | 467 | 376 | 359 |

TABLE 31

Binding affinity of Fab VH4-34_IGHD7-27*01_IGHJ4*01 & V4-6_IGLJ4*01

| | Fab [nM] | | | |
|---|---|---|---|---|
| | 340 | 170 | 85.0 | 42.5 |
| ErbB2/Fc | 1226 | 964 | 844 | 866 |
| EGF R/Fc | 1208 | 826 | 1001 | 528 |
| HGF R/Fc | 1238 | 757 | 998 | 607 |
| Notch-1/Fc | 1209 | 816 | 780 | 649 |
| CD44/Fc | 959 | 660 | 693 | 522 |
| IGF-1 sR | 1042 | 832 | 891 | 646 |
| P-Cadherin/Fc | 1160 | 744 | 709 | 421 |
| EPO R/Fc | 1255 | 790 | 817 | 494 |
| DLL4 | 2332 | 1462 | 1311 | 877 |
| Blank | 554 | 262 | 292 | 162 |

TABLE 32

Binding affinity of Fab VH3-23_IGHD3-10*01 > 3_IGHJ6*01 & O12_IGKJ1*01

| | Fab [nM] | | | |
|---|---|---|---|---|
| | 120 | 12 | 1.2 | 0.12 |
| ErbB2/Fc | 17294 | 4358 | 677 | 287 |
| EGF R/Fc | 14925 | 1984 | 464 | 272 |
| HGF R/Fc | 15917 | 2703 | 412 | 287 |
| Notch-1/Fc | 14382 | 2582 | 660 | 218 |
| CD44/Fc | 13519 | 1321 | 341 | 291 |
| IGF-1 sR | 13265 | 1135 | 181 | 175 |
| P-Cadherin/Fc | 61714 | 28490 | 1684 | 318 |
| EPO R/Fc | 33268 | 10966 | 1014 | 260 |
| DLL4 | 20627 | 2510 | 319 | 210 |
| Blank | 6749 | 573 | 227 | 264 |

TABLE 33

Binding affinity of Fab VH3-23_IGHD3-10*01 > 1'_IGHJ3*01 & O12_IGKJ1*01

| | Fab [nM] | |
|---|---|---|
| | 421.12 | 42.112 |
| ErbB2/Fc | 868 | 524 |
| EGF R/Fc | 765 | 422 |
| HGF R/Fc | 1202 | 565 |
| Notch-1/Fc | 1061 | 437 |
| CD44/Fc | 903 | 360 |
| IGF-1 sR | 1065 | 364 |
| P-Cadherin/Fc | 2949 | 1546 |
| EPO R/Fc | 1299 | 759 |
| DLL4 | 1090 | 404 |
| Blank | 639 | 323 |

B. 96-well Plate ECL Assay for Binding to DLL4

A similar ECL assay was performed as above, except only one antigen was immobilized to a single-spot per well plate for testing. Recombinant Human DLL4 (Cat#1506-D4/CF) was immobilized onto a 96-well plate by adding 5 μL (of 10 μg/ml DLL4 in PBS+0.03% Triton-X-100) to each well and incubating overnight at 20° C. One well was left blank as a control. The protein was removed and an 150 μl aliquot of 1% BSA in TBST was added to each well and allowed to incubate for 1 hour at 20° C. followed by washing 2 times with 150 μl TBST and tap drying to completely remove any residual solution. Subsequently, 25 μl aliquot of each Fab (with 1% BSA with TBST) was added to each well. The plate was sealed and incubated for 1 hour at 20° C. with shaking. As described in Examples 7 and 12, two different combinations of antigen and Fab concentrations were utilized. In one experiment, 5 μL of 30 μg/mL antigen was used to coat the plate and each Fab was tested at a concentration of 0.02 μM. In the other experiment, 5 μL of 15 μg/mL antigen was used to coat the plate and each Fab was tested at a concentration of 0.004 μM.

The Fab was subsequently removed and 25 μl anti-human Kappa Ruthenium antibody or anti-human Lambda Ruthenium antibody (1 μg/ml in 1% BSA with TBST) was added to each well and allowed to incubate for 1 hour at 20° C. with shaking. Finally, 15 μl of Read Buffer P with Surfactant (Cat # R92PC-1, Meso Scale Discovery) was added to each well. The electrochemiluminescence was measured using a Sector Imager 2400 (Meso Scale Discovery). Data was analyzed by comparing the ECL signals for an antigen to the blank of each well. A signal to blank ratio of 4 or more was considered a "Hit" Fab. The results are depicted in Examples 7-15 below.

Example 5

Surface Plasmon Resonance

In this example, the binding affinities of selected Fabs to recombinant human DLL4 (R&D Systems) were analyzed using Surface Plasmon Resonance (SPR) (Biosensor Tools, Salt Lake City, Utah). The Fabs include germline antibodies identified in the initial ECL screen as binding to DLL4 (as shown in Example 4).

The results are shown in Table 34 below. Table 34 sets forth the Fab, the $k_a$ ($M^{-1}s^{-1}$), the $k_d$ ($s^{-1}$), and the $K_D$ (nM) and the standard deviation (in parentheses). Germline Fab VH5-51_IGHD5-18*01>3_IGHJ4*01 & V3-4_IGLJ1*01 has an average $K_D$ of 4.8 µM. Germline Fab VH1-46_IGHD6-6*01_IGHJ1*01 & L6_IGKJ1*01 binds DLL4 with an average $K_D$ of 730 nM. Germline Fab VH6-1 IGHD3-3*01_IGHJ4*01 & V4-3 IGLJ4*01 has an average binding affinity of 38 µM while germline Fab VH1-46_IGHD3-10*01_IGHJ4*01 & L12_IGKJ1*01 has an average $K_D$ of 500 nM.

TABLE 34

Binding affinity of DLL4 Fabs

| Heavy Chain | SEQ ID NO | Light Chain | SEQ ID NO | $k_a$ ($M^{-1}s^{-1}$) | $k_d$ ($s^{-1}$) | $K_D$ (nM) |
|---|---|---|---|---|---|---|
| VH5-51_IGHD5-18*01 > 3_IGHJ4*01 | 89 | V3-4_IGLJ1*01 | 108 | n/a | n/a | 4800(200) |
| VH1-46_IGHD6-6*01_IGHJ1*01 | 88 | L6_IGKJ1*01 | 107 | 1.63(3)e5 | 0.101(2) | 730(130) |
| VH6-1_IGHD3-3*01_IGHJ4*01 | 90 | V4-3_IGLJ4*01 | 109 | n/a | n/a | 38000(4000) |
| VH1-46_IGHD3-10*01_IGHJ4*01 | 92 | L12_IGKJ1*01 | 115 | 5(1)e5 | 0.29(2) | 500(100) |

Example 6

ELISA Binding Assay

In this example, an ELISA binding assay was used to determine the binding of Fab antibodies to DLL4.

A. 96-well Plate

Briefly, 50 µl of a 0.5 µg/ml solution of DLL4 in 100 mM $NaHCO_3$, pH 9 was added to each well of a 96-well Costar plate (Cat #3370, Corning Inc.) and allowed to incubate for 1 hour at room temperature. The plate was blocked by adding 1% BSA in Tris-buffered Saline Tween (TBST) and incubating for 1 hour at room temperature followed by washing 2 times with 150 µl TBST. A Fab antibody was serially diluted in 1% BSA in TBST, starting at a concentration of 1000 nM. A 50 µl aliquot of each serial dilution was added, in triplicate, to each well and the plate was incubated for 1 hour at room temperature followed by washing 2 times with TBST. 50 µl of goat anti-DDDDK tag HRP conjugated polyclonal antibody diluted 1:1000 in 1% BSA TBST (Cat # AB1238-200, Abcam), was added to each well and the plate was incubated for 30 minutes at room temperature followed by washing 3 times with 200 µl TBST. Finally, 100 µl TMB one-component reagent (Cat # TMBW-1000-01, BioFax) was added and allowed to develop for 2 minutes at room temperature. The reaction was immediately halted by the addition of 100 µl 0.5 M $H_2SO_4$ and the absorbance at 450 nm was measured using an ELISA plate reader. Results using this assay are depicted in Examples 9 and 10.

B. 384-well Plate

Briefly, 10 µl of a 0.5 µg/ml solution of DLL4 in 100 mM $NaHCO_3$, pH 9 was added to each well of a 384-well Nunc Maxisorp plate (Cat #464718, Nalgene Nunc International) and allowed to incubate for 90 minutes at room temperature. The plate was blocked by adding 1% BSA in Tris-buffered Saline Tween (TBST) and incubating for 1 hour at room temperature followed by washing 2 times with 100 µl TBST. Fab antibody was serially diluted in 1% BSA in TBST, starting at a concentration of 1000 nM. A 20 µl aliquot of each serial dilution was added, in triplicate, to each well and the plate was incubated for 1 hour at room temperature followed by washing 2 times with 100 µl TBST. Depending on the light chain, 20 µl of goat anti-kappa HRP conjugated polyclonal antibody, diluted 1:1000 in 1% BSA TBST (Cat # A7164-1 mL, Sigma-Aldrich) or goat anti-lambda HRP conjugated polyclonal antibody, diluted 1:1000 in 1% BSA TBST (Cat # L1645-1 ml, Sigma-Aldrich) was added to each well and the plate was incubated for 1 hour at room temperature followed by washing 4 times with 100 µl TBST. Finally, 25 µl TMB one-component reagent reagent (Cat # TMBW-1000-01, BioFax) was added and allowed to develop for 1-5 minutes at room temperature. The reaction was immediately halted by the addition of 25 µl 0.5 M $H_2SO_4$ and the absorbance at 450 nm was measured using an ELISA plate reader. Results using this assay are depicted in Examples 9 and 10.

Example 7

Affinity Maturation of Th Heavy Chain of Anti-DLL4 "Hit" VH1-46_IGHD6-6*01_IGHJ1*01 & L6_IGKJ1*01 a. Summary

The heavy and light chain amino acid sequence of Fab "Hit" VH1-46_IGHD6-6*01_IGHJ1*01 & L6_IGKJ1*01 (SEQ ID NOS:88 and 107) against DLL4, identified in Example 4 using the Multispot ECL binding assay, was aligned with the heavy and light chain amino acid sequence of a related "non-Hit" Fab antibody that had a related heavy or light chain but did not bind to DLL4. Based on the alignment, amino acid residues that differed between the "Hit" and "non-Hit" antibodies were identified in each of the heavy and light chain as potential amino acids involved in binding for subsequent affinity maturation. Affinity maturation of the heavy chain is described in Examples 7-9. Affinity maturation of the light chain is described in Example 10.

Briefly, the identified amino acid residues were subjected to alanine-scanning mutagenesis and resultant mutant Fabs tested to assess the affect of the mutation on binding of the antibody to DLL4. Mutated residues that did not affect binding of the antibody to DLL4 were identified and subjected to further mutagenesis using overlapping PCR with NNK mutagenesis. Mutant antibodies were assessed for DLL4 binding, and mutations that improved binding to DLL4 were identified. Combinations mutants were generated containing each of the identified single mutants; combination mutants were further assayed for binding to DLL4. Further optimization was performed by mutating other regions of the antibody. By this method, anti-DLL4 antibodies were generated with significantly improved binding affinity for DLL4 compared to the parent "Hit" VH1-46_IGHD6-6*01_IGHJ1*01 & L6_IGKJ1*01 Fab antibody.

b. Affinity Maturation of Heavy Chain
i. Identification of the CDR Potential Binding Site The amino acid sequence of the heavy chain (SEQ ID NO:88) for the parent "Hit" VH1-46_IGHD6-6*01_IGHJ1*01 & L6_IGKJ1*01 was aligned with the amino acid sequence of a related heavy chain (SEQ ID NO:93) of a non-Hit that was identified as not binding to DLL4, i.e. VH1-46_IGHD6-13*01_IGHJ4*01 & L6_IGKJ1*01. "Hit" Fab VH1-46_IGHD6-6*01_IGHJ1*01 & L6_IGKJ1*01 had an ECL signal/blank ratio of 23.1 while that of the non-Hit Fab VH1-46_IGHD6-13*01_IGHJ4*01 & L6_IGKJ1*01 was only 2.4. These two Fabs are related because they share the same $V_H$ germline segment. Further, the $D_H$ germline segment is of the same gene family (i.e. IGHD6). The sequence alignment is set forth in FIG. 1. Based on the alignment, amino acid residues were identified that differed between the "Hit" and "non-Hit," thus accounting for the differences in binding of the "Hit" and "non-Hit" anti-DLL4 antibodies. The identified amino acid residues were located in CDR3, which was identified as the region of the heavy chain that is important for binding affinity.

ii. Alanine Scanning of CDR3

Alanine scanning mutagenesis was performed on amino acid residues in the CDR3 of the heavy chain sequence of parent Fab VH1-46_IGHD6-6*01_IGHJ1*01 & L6_IGKJ1*01 to identify amino acid residues that do not appear to be involved in DLL4 binding. Alanine-scanning of the CDR3 region of the heavy chain sequence of parent Fab VH1-46_IGHD6-6*01_IGHJ1*01 & L6_IGKJ1*01 was performed by mutating every residue of the CDR3 region to an alanine, except amino acid residues A106, Y108, and F109. The mutant Fab antibodies were expressed and purified as described in Example 2 above.

Purified Fab alanine mutants were tested for binding to DLL4 using the ECL 96-well plate assay as described in Example 4B. 5 µL of 10 µg/mL recombinant Human DLL4 antigen was coated to to a 96-well plate, and tested Fab mutants were added at a concentration of 0.04 µM. As a control, background binding of the Fab to a blank well of the 96-well plate also was determined. The data were depicted as a Signal/Noise ratio of the ECL signal, which is the ratio of the ECL signal for binding to DLL4 divided by the ECL signal for residual binding to the plate. Table 35 sets forth the mutant Fabs tested and the Signal/Noise ratio observed for binding to DLL4. The results show that mutation of E100, Y101, S105, E107 or Q110 with alanine caused a reduction in the ECL signal and therefore decreased binding affinity to DLL4. These residues, therefore, appeared to be involved in the DLL4 binding and were not further mutagenized. In contrast, mutation of S102, S103, S104 or H111 with alanine resulted in either an increased ECL signal or no difference in ECL signal compared to the parent and thus either improved binding affinity or did not affect binding affinity to DLL4. Accordingly, these residues were identified as residues for further mutagenesis.

The ECL binding experiments above were repeated, except with varying concentrations of mutant Fab and DLL4 protein. Table 36 sets forth the mutant Fab, the ECL signal, and the Signal/Noise ratio for two different concentrations of DLL4 antigen and mutant Fab. The results are consistent for both assays and confirm the initial results above. Substitution of E100, Y101, S105, E107 or Q110 with alanine caused a reduction in ECL signal for binding to DLL4 while substitution of S102, S103, S104 or H111 with alanine either improved the ECL signal for binding or did not affect the ECL signal for binding to DLL4.

TABLE 35

Fab VH1-46_IGHD6-6*01_IGHJ1*01 & L6_IGKJ1*01 alanine mutant binding data

| | Fab | | | Signal/Noise |
|---|---|---|---|---|
| Heavy Chain | SEQ ID NO | Light Chain | SEQ ID NO | (0.04 µM) |
| E100A | 129 | L6_IGKJ1*01 | 107 | 0.9 |
| Y101A | 130 | L6_IGKJ1*01 | 107 | 0.8 |
| S102A | 124 | L6_IGKJ1*01 | 107 | 5.6 |
| S103A | 131 | L6_IGKJ1*01 | 107 | 3.5 |
| S104A | 122 | L6_IGKJ1*01 | 107 | 1.3 |
| S105A | 132 | L6_IGKJ1*01 | 107 | 0.8 |
| E107A | 133 | L6_IGKJ1*01 | 107 | 0.7 |
| Q110A | 134 | L6_IGKJ1*01 | 107 | 0.9 |
| H111A | 135 | L6_IGKJ1*01 | 107 | 2.4 |
| parental | 88 | L6_IGKJ1*01 | 107 | 3.1 |

TABLE 36

Fab VH1-46_IGHD6-6*01_IGHJ1*01 & L6_IGKJ1*01 alanine mutant binding data

| | | | Fab | | | |
|---|---|---|---|---|---|---|
| | | | 0.02 µM Fab 30 µg/mL DLL4 | | 0.004 µM Fab 15 µg/mL DLL4 | |
| Heavy Chain | SEQ ID NO | Light Chain (SEQ ID NO: 107) | ECL Signal | Signal/ Noise | ECL Signal | Signal/ Noise |
| VH1-46_IGHD6-6*01_IGHJ1*01 | 88 | L6_IGKJ1*01 | 8714 | 23.0 | 4261 | 29.2 |
| E100A | 129 | L6_IGKJ1*01 | 1296 | 3.4 | 536 | 3.7 |
| Y101A | 130 | L6_IGKJ1*01 | 237 | 0.6 | 340 | 2.3 |
| S102A | 124 | L6_IGKJ1*01 | 19056 | 50.3 | 10338 | 70.8 |
| S103A | 131 | L6_IGKJ1*01 | 11553 | 30.5 | 5150 | 35.3 |
| S104A | 122 | L6_IGKJ1*01 | 163452 | 431.3 | 3614 | 24.8 |

TABLE 36-continued

Fab VH1-46_IGHD6-6*01_IGHJ1*01 & L6_IGKJ1*01 alanine mutant binding data

| | | | Fab | | | |
|---|---|---|---|---|---|---|
| | | | 0.02 µM Fab 30 µg/mL DLL4 | | 0.004 µM Fab 15 µg/mL DLL4 | |
| Heavy Chain | SEQ ID NO | Light Chain (SEQ ID NO: 107) | ECL Signal | Signal/ Noise | ECL Signal | Signal/ Noise |
| S105A | 132 | L6_IGKJ1*01 | 1103 | 2.9 | 181 | 1.2 |
| E107A | 133 | L6_IGKJ1*01 | 338 | 0.9 | 146 | 1.0 |
| Q110A | 134 | L6_IGKJ1*01 | 257 | 0.7 | 128 | 0.9 |
| H111A | 135 | L6_IGKJ1*01 | 11582 | 30.6 | 5023 | 34.4 | iii. NNK Mutagenesis of Heavy Chain Amino Acid Residues S102, S103, S104

Following alanine scanning mutagenesis of CDR3, heavy chain amino acid residues S102, S103 and S104 were selected for further mutation using overlapping PCR with NNK mutagenesis as described in Example 1 using parent Fab VH1-46_IGHD6-6*01_IGHJ1*01 & L6_IGKJ1*01 as a template.

The binding affinity of each generated Fab mutant for DLL4 was determined using the 96-well plate ECL assay described in Example 4 with varying concentrations of Fab and DLL4 protein. Table 37 sets forth the Signal/Noise ratio for each of the S102, S103 and S104 NNK mutants. Fab NNK mutants were selected at random prior to sequencing and therefore several mutants, such as S103L, were purified and tested multiple times giving consistent results. Three mutations in Fab VH1-46_IGHD6-6*01_IGHJ1*01 & L6_IGKJ1*01 were identified that resulted in a Fab with an increased signal/noise ratio and therefore improved binding affinity to DLL4. Two Fab mutants, S102A and S103P, each had an signal/noise ratio for DLL4 approximately 3-fold greater than parent Fab VH1-46_IGHD6-6*01_IGHJ1*01 & L6_IGKJ1*01. A third mutant, heavy chain Fab mutant S104F, had a signal/noise ratio for binding to DLL4 at least 4-fold greater than that of parent Fab VH1-46_IGHD6-6*01_IGHJ1*01 & L6_IGKJ1*01. Two additional mutations were identified that resulted in a slight increase in the signal/noise ratio for binding to DLL4, namely Fab heavy chain mutants S103A and S104H.

TABLE 37

NNK mutagenesis of Fab VH1-46_IGHD6-6*01_IGHJ1*01 and L6_IGKJ1*01 at amino acid residues S102, S103 and S104

| | | | 0.02 µM Fab | 0.004 µM Fab |
|---|---|---|---|---|
| | | | Fab | Fab |
| Heavy Chain | SEQ ID NO | Light Chain (SEQ ID NO: 107) | 30 µg/mL DLL4 Signal/Noise | 15 µg/mL DLL4 Signal/Noise |
| VH1-46_IGHD6-6*01_IGHJ1*01 | 88 | L6_IGKJ1*01 | 19.5 | 25.0 |
| VH1-46_IGHD6-6*01_IGHJ1*01 | 88 | L6_IGKJ1*01 | 24.8 | 19.5 |
| VH1-46_IGHD6-6*01_IGHJ1*01 | 88 | L6_IGKJ1*01 | 20.3 | 28.3 |
| S102Q | 136 | L6_IGKJ1*01 | 40.6 | 31.9 |
| S102V | 137 | L6_IGKJ1*01 | 35.9 | 36.5 |
| S102I | 138 | L6_IGKJ1*01 | 35.3 | 34.5 |
| S102A | 124 | L6_IGKJ1*01 | 51.7 | 69.8 |
| S102G | 139 | L6_IGKJ1*01 | 5.1 | 5.2 |
| S103stop | 234 | L6_IGKJ1*01 | 0.8 | 1.1 |
| S103L | 140 | L6_IGKJ1*01 | 25.8 | 36.6 |
| S103W | 141 | L6_IGKJ1*01 | 16.3 | 25.0 |
| S103L | 140 | L6_IGKJ1*01 | 27.0 | 36.8 |
| S103L | 140 | L6_IGKJ1*01 | 39.8 | 44.9 |
| S103F | 142 | L6_IGKJ1*01 | 16.4 | 20.7 |
| S103L | 140 | L6_IGKJ1*01 | 22.5 | 30.7 |
| S103L | 140 | L6_IGKJ1*01 | 18.7 | 28.1 |
| S103N | 143 | L6_IGKJ1*01 | 18.8 | 23.8 |
| S103H | 144 | L6_IGKJ1*01 | 21.7 | 31.7 |
| S103C | 145 | L6_IGKJ1*01 | 27.1 | 27.4 |
| S103L | 140 | L6_IGKJ1*01 | 22.1 | 36.3 |
| S103L | 140 | L6_IGKJ1*01 | 24.0 | 40.4 |
| S103A | 131 | L6_IGKJ1*01 | 30.9 | 44.5 |
| S103A | 131 | L6_IGKJ1*01 | 29.1 | 32.9 |
| S103L | 140 | L6_IGKJ1*01 | 26.6 | 30.7 |
| S103G | 146 | L6_IGKJ1*01 | 9.1 | 8.3 |
| S103W | 141 | L6_IGKJ1*01 | 25.8 | 38.8 |
| S103F | 142 | L6_IGKJ1*01 | 21.9 | 21.2 |
| S103P | 123 | L6_IGKJ1*01 | 59.7 | 82.4 |
| S103N | 143 | L6_IGKJ1*01 | 13.4 | 22.4 |
| S104G | 147 | L6_IGKJ1*01 | 23.4 | 20.0 |
| S104C | 148 | L6_IGKJ1*01 | 9.9 | 8.4 |
| S104H | 149 | L6_IGKJ1*01 | 24.9 | 79.2 |
| S104L | 150 | L6_IGKJ1*01 | 23.5 | 43.8 |
| S104R | 151 | L6_IGKJ1*01 | 23.4 | 28.6 |
| S104G | 147 | L6_IGKJ1*01 | 45.5 | 67.8 |
| S104F | 121 | L6_IGKJ1*01 | 76.5 | 134.2 |
| S104L | 150 | L6_IGKJ1*01 | 24.8 | 25.6 |

The Fab heavy chain mutants, S102A, S103A, S103P, S104H and S104F, each containing a mutation in the heavy chain parent Fab VH1-46_IGHD6-6*01_IGHJ1*01 & L6_IGKJ1*01, were subsequently re-assayed using the ECL multispot assay as describe in Example 4A to confirm the observed increased binding affinity for DLL4. Each Fab mutant was tested against a panel of antigens at two different Fab concentrations. The results are set forth in Tables 38-39 below. Table 29 sets forth the results for the ECL signal and signal/noise ratio of each mutant for binding to DLL4. Table 38 sets forth the signal/noise ratio for binding to all of the tested antigens. The results show that the heavy chain mutants S102A, S103P, S104H and S104F all have increased signals for binding to DLL4 as compared to parent Fab VH1-46_IGHD6-6*01_IGHJ1*01 & L6_IGKJ1*01, and additionally these mutants bind in a dose-dependent and antigen specific manner. Further, the results show that the signal for binding of heavy chain mutant S103A to DLL4 is about the same as binding of parent Fab VH1-46_IGHD6-6*01_IGHJ1*01 & L6_IGKJ1*01.

TABLE 38

Binding affinity of Fab VH1-46_IGHD6-6*01_IGHJ1*01 and L6_IGKJ1*01
heavy chain mutants S102A, S103A, S103P, S104H, and S104F for DLL4

| Heavy Chain | SEQ ID NO | Light Chain (SEQ ID NO: 107) | Fab [µM] | Signal | Blank | Signal/Noise |
|---|---|---|---|---|---|---|
| S103A | 131 | L6_IGKJ1*01 | 0.1 | 7108 | 225 | 31.6 |
| S103A | 131 | L6_IGKJ1*01 | 0.01 | 1192 | 265 | 4.5 |
| S103P | 123 | L6_IGKJ1*01 | 0.1 | 19284 | 139 | 138.7 |
| S103P | 123 | L6_IGKJ1*01 | 0.01 | 4095 | 179 | 22.9 |
| S104H | 149 | L6_IGKJ1*01 | 0.1 | 20053 | 227 | 88.3 |
| S104H | 149 | L6_IGKJ1*01 | 0.01 | 4159 | 154 | 27.0 |
| S104F | 121 | L6_IGKJ1*01 | 0.1 | 27072 | 139 | 194.8 |
| S104F | 121 | L6_IGKJ1*01 | 0.01 | 4283 | 280 | 15.3 |
| Parent | 88 | L6_IGKJ1*01 | 0.1 | 7002 | 171 | 40.9 |
| Parent | 88 | L6_IGKJ1*01 | 0.01 | 1030 | 210 | 4.9 |
| S102A | 124 | L6_IGKJ1*01 | 0.1 | 15754 | 220 | 71.6 |
| S102A | 124 | L6_IGKJ1*01 | 0.01 | 2598 | 259 | 10.0 |

TABLE 39

Binding affinity and specificity of Fab VH1-46_IGHD6-6*01_IGHJ1*01 and
L6_IGKJ1*01 heavy chain mutants S102A, S103A, S103P, S104H, and S104F

| | Fab [µM] | ErbB2 | EGF R | HGF R | Notch-1 | CD44 | IGF-1 | P-Cad | EPO R | DLL4 |
|---|---|---|---|---|---|---|---|---|---|---|
| S103A | 0.1 | 1.0 | 1.2 | 1.0 | 1.2 | 1.4 | 1.2 | 1.4 | 1.4 | 31.6 |
| S103A | 0.01 | 0.9 | 1.3 | 1.2 | 1.4 | 1.3 | 1.1 | 1.3 | 1.1 | 4.5 |
| S103P | 0.1 | 2.2 | 2.3 | 1.9 | 2.6 | 2.1 | 2.0 | 1.4 | 2.4 | 138.7 |
| S103P | 0.01 | 2.0 | 1.8 | 1.2 | 1.8 | 1.5 | 1.0 | 1.1 | 1.8 | 22.9 |
| S104H | 0.1 | 1.0 | 0.6 | 0.8 | 0.8 | 1.1 | 1.0 | 0.8 | 1.0 | 88.3 |
| S104H | 0.01 | 1.0 | 1.0 | 1.0 | 1.4 | 1.4 | 1.5 | 1.0 | 1.2 | 27.0 |
| S104F | 0.1 | 1.8 | 2.0 | 1.6 | 2.6 | 1.9 | 1.7 | 1.4 | 2.1 | 194.8 |
| S104F | 0.01 | 0.7 | 0.8 | 0.6 | 0.8 | 0.8 | 0.6 | 0.4 | 0.7 | 15.3 |
| Parent | 0.1 | 1.2 | 1.2 | 1.3 | 1.7 | 1.8 | 1.6 | 1.6 | 1.2 | 40.9 |
| Parent | 0.01 | 1.0 | 0.9 | 0.9 | 0.5 | 1.1 | 0.8 | 1.0 | 1.0 | 4.9 |
| S102A | 0.1 | 0.8 | 0.9 | 0.5 | 1.4 | 1.3 | 1.3 | 1.0 | 1.3 | 71.6 |
| S102A | 0.01 | 1.0 | 0.8 | 0.5 | 0.6 | 0.9 | 0.5 | 0.2 | 0.8 | 10.0 | iv. Combination Mutants Based on NNK Mutagenesis Results

Fab VH1-46_IGHD6-6*01_IGHJ1*01 & L6_IGKJ1*01 heavy chain mutants S102A, S103P and S104F, identified as contributing to increased binding to DLL4, were combined to generate a triple mutant. The triple mutant is designated as Fab VH1-46_IGHD6-6*01_IGHJ1*01 S102A/S103P/S104F & L6_IGKJ1*01 (H:APF & L:wt). The binding affinity and specificity of the Fab APF triple mutant was determined using both the ECL multispot assay and ELISA.

The ECL multispot assay described in Example 4A was used to compare the specificity and binding affinity of the APF triple mutant and the parent antibody for binding to DLL4 and other antigens at various concentrations of antibody. Table 40 sets forth the signal/noise ratio for binding of the parent and APF triple mutant against the tested antigens. The results show that the heavy chain APF triple mutant binds DLL4 with 10-fold greater binding affinity than the parent antibody. Additionally, the APF triple mutant specifically binds DLL4, since no detectable signal was observed for binding to any other tested antigen.

The binding of the APF triple mutant to DLL4 was further analyzed by ELISA as described in Example 6 at Fab concentrations of 125 nm to 1000 nm antibody. The results are set forth in Table 41 below. At the tested concentrations, the parent Fab antibody did not show a detectable signal for binding to DLL4. In contrast, the APF triple mutant had a detectable signal evidencing DLL4 binding in a concentration dependent manner. These results confirm that the ECL assay is more sensitive then the ELISA assay.

TABLE 40

Binding affinity and specificity of triple mutant Fab VH1-46_IGHD6-6*01_IGHJ1*01
S102A/S103P/S104F (APF) & L6_IGKJ1*01 (SEQ ID NOS: 125 and 107) as compared to parent Fab
VH1-46_IGHD6-6*01_IGHJ1*01 & L6_IGKJ1*01 (SEQ ID NOS: 88 and 107)

| | Fab [µM] | ErbB2 | EGF R | HGF R | Notch-1 | CD44 | IGF-1 | P-Cad | EPO R | DLL4 |
|---|---|---|---|---|---|---|---|---|---|---|
| Wt | 500.00 | 0.3 | 0.7 | 0.3 | 0.8 | 0.4 | 0.4 | 0.2 | 0.8 | 16.2 |
| | 50.00 | 0.6 | 0.9 | 0.6 | 0.6 | 0.3 | 0.5 | 0.7 | 0.9 | 33.5 |
| | 5.00 | 1.0 | 1.0 | 0.9 | 0.8 | 1.3 | 1.1 | 0.9 | 1.1 | 32.5 |
| | 0.50 | 1.0 | 1.4 | 0.6 | 2.0 | 1.0 | 1.2 | 1.3 | 0.9 | 2.9 |
| S102A, S103P, S104F | 500.00 | 1.7 | 5.5 | 2.2 | 4.2 | 2.4 | 1.5 | 3.4 | 10.4 | 181.4 |
| | 50.00 | 0.7 | 1.0 | 0.7 | 1.1 | 0.7 | 0.5 | 0.9 | 1.6 | 274.5 |
| | 5.00 | 1.1 | 1.1 | 0.8 | 0.9 | 1.3 | 1.1 | 1.0 | 1.8 | 482.1 |
| | 0.50 | 1.0 | 1.1 | 0.8 | 1.4 | 1.0 | 1.3 | 0.8 | 0.9 | 34.5 |

TABLE 41

Binding affinity of triple mutant Fab VH1-46_IGHD6-6*01_IGHJ1*01 S102A/S103P/S104F (APF) & L6_IGKJ1*01 (SEQ ID NOS: 125 and 107) as compared to parent Fab VH1-46_IGHD6-6*01_IGHJ1*01 & L6_IGKJ1*01 (SEQ ID NOS: 88 and 107)

| Fab [nM] | Wildtype | Blank | S102A, S103P, S104F | Blank |
|---|---|---|---|---|
| 1000 | 0.071 | 0.060 | 0.463 | 0.080 |
| 500 | 0.070 | 0.069 | 0.307 | 0.074 |
| 250 | 0.069 | 0.064 | 0.231 | 0.071 |
| 125 | 0.070 | 0.066 | 0.173 | 0.075 |

Example 8

Further Optimization of the Heavy Chain of Anti-DLL4 APF Triple Mutant for Binding to DLL4

In this example, the heavy chain of the APF triple mutant described and generated in Example 7 was further optimized to improve its binding affinity for DLL4. The APF triple mutant Fab was used as a template for further mutagenesis of heavy chain amino acid residues in the remaining CDR regions of the antibody heavy chain. Amino acid residue G55 of CDR2 and amino acid residues E100, A106, Y108, F109, and H111 of CDR3 were subjected to mutagenesis using overlapping PCR with NNK mutagenesis, as described above in Example 1.

The Fab APF triple mutant containing further mutations at amino acid residues E100, A106, Y108, F109, and H111 were tested for binding to DLL4 and other antigens using the ECL Multispot Assay at a concentration of 10 nM Fab. The results are set forth in Tables 42-43 below. The Signal/Noise ratio of each mutant Fab tested for binding to DLL4 is set forth in Table 42. Table 43 sets forth the ECL signal and blank (background binding to control well containing no antigen) for the binding of each mutant Fab to various tested antigens. Amino acid mutations designated with X (for any amino acid) did not show appreciable binding and therefore were not sequenced to identify the exact mutation. The results show that mutation of amino acid residues G55, E100, A106, Y108, or F109 with any other amino acid generally caused a reduction in binding affinity to DLL4 as evidenced by a reduction in ECL signal while substitution of H111 either improved binding affinity or did not affect binding affinity to DLL4 as evidenced by an increased ECL signal or no change in ECL signal. In particular, Fab heavy chain mutant VH1-46_IGHD6-6*01_IGHJ1*01 S102A/S103P/S104F/H111F & L6_IGKJ1*01 (H:APFF & L:wt) had a 2 to 4-fold better signal/noise ratio for binding to DLL4 than the Fab APF triple mutant. Additionally, none of the mutants showed any appreciable binding to any of the other tested antigens (see Table 43 below.)

TABLE 42

NNK mutagenesis of Fab VH1-46_IGHD6-6*01_IGHJ1*01 S102A/S103P/S104F (APF) & L6_IGKJ1*01 at amino acid residues G55, E100, A106, Y108, F109 and H111

Fab [10 nM]

| Heavy | SEQ ID NO | Light (SEQ ID NO: 107) | Signal/Noise |
|---|---|---|---|
| S102A/S103P/S104F | 125 | L6_IGKJ1*01 | 12.8 |
| S102A/S103P/S104F | 125 | L6_IGKJ1*01 | 10.4 |
| S102A/S103P/S104F G55W | 152 | L6_IGKJ1*01 | 8.0 |
| S102A/S103P/S104F G55X | 235 | L6_IGKJ1*01 | 1.4 |
| S102A/S103P/S104F G55X | 235 | L6_IGKJ1*01 | 1.1 |
| S102A/S103P/S104F G55X | 235 | L6_IGKJ1*01 | 1.0 |
| S102A/S103P/S104F G55X | 235 | L6_IGKJ1*01 | 0.8 |
| S102A/S103P/S104F G55X | 235 | L6_IGKJ1*01 | 0.6 |
| S102A/S103P/S104F G55D | 153 | L6_IGKJ1*01 | 1.2 |
| S102A/S103P/S104F | 125 | L6_IGKJ1*01 | 11.1 |
| S102A/S103P/S104F G55X | 235 | L6_IGKJ1*01 | 1.3 |
| S102A/S103P/S104F E100X | 236 | L6_IGKJ1*01 | 1.2 |
| S102A/S103P/S104F E100X | 236 | L6_IGKJ1*01 | 1.0 |
| S102A/S103P/S104F | 125 | L6_IGKJ1*01 | 20.4 |
| S102A/S103P/S104F E100X | 236 | L6_IGKJ1*01 | 1.1 |
| S102A/S103P/S104F E100X | 236 | L6_IGKJ1*01 | 1.0 |
| S102A/S103P/S104F E100X | 236 | L6_IGKJ1*01 | 1.7 |
| S102A/S103P/S104F E100X | 236 | L6_IGKJ1*01 | 1.2 |
| S102A/S103P/S104F E100X | 236 | L6_IGKJ1*01 | 1.5 |
| S102A/S103P/S104F | 125 | L6_IGKJ1*01 | 14.9 |
| S102A/S103P/S104F A106X | 237 | L6_IGKJ1*01 | 0.7 |
| S102A/S103P/S104F A106X | 237 | L6_IGKJ1*01 | 0.9 |
| S102A/S103P/S104F A106X | 237 | L6_IGKJ1*01 | 1.2 |
| S102A/S103P/S104F A106X | 237 | L6_IGKJ1*01 | 1.7 |
| S102A/S103P/S104F A106X | 237 | L6_IGKJ1*01 | 1.1 |
| S102A/S103P/S104F A106X | 237 | L6_IGKJ1*01 | 1.5 |
| S102A/S103P/S104F A106X | 237 | L6_IGKJ1*01 | 1.9 |
| S102A/S103P/S104F | 125 | L6_IGKJ1*01 | 16.0 |
| S102A/S103P/S104F | 125 | L6_IGKJ1*01 | 13.8 |
| S102A/S103P/S104F A106X | 237 | L6_IGKJ1*01 | 1.1 |
| S102A/S103P/S104F Y108X | 238 | L6_IGKJ1*01 | 0.9 |
| S102A/S103P/S104F Y108X | 238 | L6_IGKJ1*01 | 1.6 |
| S102A/S103P/S104F Y108X | 238 | L6_IGKJ1*01 | 11.7 |
| S102A/S103P/S104F Y108X | 238 | L6_IGKJ1*01 | 1.2 |
| S102A/S103P/S104F | 125 | L6_IGKJ1*01 | 17.6 |
| S102A/S103P/S104F Y108X | 238 | L6_IGKJ1*01 | 6.2 |
| S102A/S103P/S104F | 125 | L6_IGKJ1*01 | 18.0 |
| S102A/S103P/S104F A106E | 154 | L6_IGKJ1*01 | 4.3 |
| S102A/S103P/S104F Y108X | 238 | L6_IGKJ1*01 | 8.0 |
| S102A/S103P/S104F Y108X | 238 | L6_IGKJ1*01 | 0.8 |
| S102A/S103P/S104F F109X | 239 | L6_IGKJ1*01 | 1.1 |
| S102A/S103P/S104F F109X | 239 | L6_IGKJ1*01 | 1.2 |
| S102A/S103P/S104F | 125 | L6_IGKJ1*01 | 9.9 |
| S102A/S103P/S104F F109X | 239 | L6_IGKJ1*01 | 4.5 |
| S102A/S103P/S104F F109X | 239 | L6_IGKJ1*01 | 0.9 |
| S102A/S103P/S104F | 125 | L6_IGKJ1*01 | 12.0 |
| S102A/S103P/S104F F109X | 239 | L6_IGKJ1*01 | 1.0 |
| S102A/S103P/S104F F109X | 239 | L6_IGKJ1*01 | 1.3 |
| S102A/S103P/S104F F109X | 239 | L6_IGKJ1*01 | 26.4 |
| S102A/S103P/S104F | 125 | L6_IGKJ1*01 | 1.8 |
| S102A/S103P/S104F H111X | 240 | L6_IGKJ1*01 | 1.1 |
| S102A/S103P/S104F H111F | 126 | L6_IGKJ1*01 | 42.5 |
| S102A/S103P/S104F | 125 | L6_IGKJ1*01 | 14.5 |
| S102A/S103P/S104F | 125 | L6_IGKJ1*01 | 13.7 |
| S102A/S103P/S104F H111X | 240 | L6_IGKJ1*01 | 2.4 |
| S102A/S103P/S104F | 125 | L6_IGKJ1*01 | 12.3 |
| S102A/S103P/S104F H111X | 240 | L6_IGKJ1*01 | 12.4 |
| S102A/S103P/S104F H111X | 240 | L6_IGKJ1*01 | 6.2 |
| S102A/S103P/S104F | 125 | L6_IGKJ1*01 | 24.7 |
| S102A/S103P/S104F H111S | 155 | L6_IGKJ1*01 | 24.0 |

TABLE 43

NNK mutagenesis of Fab VH1-46_IGHD6-6*01_IGHJ1*01 S102A/S103P/S104F (APF) & L6_IGKJ1*01 at amino acid residues G55, E100, A106, Y108, F109 and H111

| Heavy Chain [10 nM Fab] | ErbB2 | EGF R | HGF R | Notch-1 | CD44 | IGF-1 | P-Cad | EPO R | Blank |
|---|---|---|---|---|---|---|---|---|---|
| APF | 330 | 272 | 306 | 257 | 189 | 241 | 297 | 304 | 271 |
| APF | 157 | 237 | 272 | 334 | 96 | 197 | 208 | 329 | 204 |
| APF G55W | 334 | 312 | 365 | 327 | 159 | 250 | 391 | 296 | 271 |
| APF G55X | 284 | 190 | 331 | 333 | 165 | 330 | 234 | 275 | 317 |
| APF G55X | 189 | 280 | 182 | 208 | 256 | 202 | 190 | 235 | 301 |
| APF G55X | 145 | 207 | 277 | 436 | 298 | 228 | 301 | 339 | 314 |
| APF G55X | 323 | 307 | 301 | 334 | 257 | 247 | 357 | 261 | 324 |
| APF G55X | 113 | 192 | 254 | 182 | 172 | 192 | 128 | 279 | 235 |
| APF G55D | 302 | 272 | 268 | 302 | 173 | 191 | 243 | 329 | 248 |
| APF | 340 | 216 | 171 | 130 | 236 | 174 | 256 | 285 | 239 |
| APF G55X | 305 | 352 | 377 | 383 | 234 | 248 | 440 | 343 | 245 |
| APF E100X | 273 | 273 | 322 | 265 | 291 | 309 | 271 | 304 | 222 |
| APF E100X | 358 | 287 | 318 | 358 | 304 | 249 | 226 | 284 | 297 |
| APF | 91 | 159 | 212 | 181 | 127 | 238 | 59 | 159 | 95 |
| APF E100X | 314 | 365 | 451 | 418 | 262 | 177 | 430 | 327 | 326 |
| APF E100X | 357 | 267 | 379 | 171 | 257 | 241 | 205 | 222 | 229 |
| APF E100X | 172 | 158 | 188 | 142 | 197 | 169 | 206 | 140 | 132 |
| APF E100X | 229 | 285 | 306 | 144 | 159 | 177 | 249 | 324 | 273 |
| APF E100X | 279 | 267 | 395 | 293 | 295 | 355 | 436 | 302 | 220 |
| APF | 314 | 241 | 388 | 304 | 188 | 291 | 396 | 303 | 243 |
| APF A106X | 200 | 170 | 441 | 336 | 158 | 241 | 267 | 309 | 366 |
| APF A106X | 288 | 244 | 319 | 153 | 276 | 221 | 235 | 248 | 283 |
| APF A106X | 306 | 428 | 452 | 268 | 268 | 320 | 336 | 398 | 390 |
| APF A106X | 349 | 350 | 324 | 270 | 239 | 215 | 367 | 239 | 157 |
| APF A106X | 24 | 253 | 177 | 319 | 297 | 248 | 368 | 258 | 232 |
| APF A106X | 393 | 406 | 380 | 434 | 339 | 404 | 506 | 333 | 237 |
| APF A106X | 174 | 238 | 122 | 63 | 296 | 246 | 159 | 161 | 247 |
| APF | 202 | 138 | 190 | 189 | 199 | 190 | 152 | 179 | 214 |
| APF | 378 | 277 | 317 | 370 | 262 | 207 | 422 | 312 | 306 |
| APF A106X | 273 | 324 | 240 | 331 | 242 | 229 | 251 | 308 | 249 |
| APF Y108X | 270 | 300 | 294 | 315 | 169 | 285 | 285 | 384 | 385 |
| APF Y108X | 283 | 272 | 236 | 306 | 321 | 258 | 313 | 334 | 167 |
| APF Y108X | 322 | 253 | 314 | 314 | 295 | 240 | 189 | 345 | 219 |
| APF Y108X | 405 | 355 | 438 | 464 | 376 | 334 | 340 | 399 | 321 |
| APF | 413 | 324 | 269 | 390 | 385 | 270 | 301 | 421 | 320 |
| APF Y108X | 336 | 320 | 276 | 297 | 208 | 343 | 246 | 178 | 211 |
| APF | 200 | 255 | 258 | 336 | 214 | 230 | 280 | 228 | 198 |
| APF A106E | 189 | 226 | 212 | 156 | 192 | 312 | 308 | 204 | 219 |
| APF Y108X | 239 | 261 | 277 | 292 | 325 | 337 | 333 | 271 | 368 |
| APF Y108X | 388 | 355 | 423 | 348 | 248 | 380 | 469 | 276 | 336 |
| APF F109X | 378 | 397 | 429 | 362 | 440 | 400 | 509 | 479 | 428 |
| APF F109X | 405 | 444 | 462 | 544 | 324 | 442 | 503 | 441 | 402 |
| APF | 513 | 460 | 339 | 433 | 298 | 318 | 338 | 252 | 372 |
| APF F109X | 294 | 442 | 433 | 382 | 350 | 272 | 379 | 440 | 387 |
| APF F109X | 417 | 334 | 371 | 446 | 235 | 320 | 416 | 463 | 438 |
| APF | 356 | 371 | 434 | 363 | 417 | 293 | 293 | 389 | 344 |
| APF F109X | 304 | 241 | 246 | 369 | 392 | 320 | 351 | 340 | 347 |
| APF F109X | 350 | 399 | 340 | 217 | 338 | 407 | 314 | 376 | 331 |
| APF F109X | 147 | 158 | 298 | 249 | 334 | 260 | 206 | 241 | 148 |
| APF | 221 | 296 | 319 | 251 | 221 | 344 | 449 | 222 | 182 |
| APF H111X | 410 | 414 | 382 | 427 | 362 | 488 | 607 | 430 | 476 |
| APF H111F | 370 | 409 | 493 | 356 | 360 | 345 | 461 | 343 | 290 |
| APF | 381 | 206 | 379 | 450 | 363 | 453 | 384 | 326 | 487 |
| APF | 391 | 428 | 426 | 299 | 400 | 434 | 433 | 480 | 472 |
| APF H111X | 395 | 315 | 298 | 380 | 322 | 387 | 392 | 443 | 454 |
| APF | 525 | 467 | 422 | 376 | 345 | 361 | 305 | 494 | 363 |
| APF H111X | 91 | 292 | 134 | 297 | 164 | 158 | 143 | 291 | 186 |
| APF H111X | 207 | 188 | 256 | 177 | 192 | 142 | 223 | 181 | 185 |
| APF | 302 | 394 | 200 | 283 | 340 | 213 | 118 | 343 | 204 |
| APF H111S | 314 | 286 | 235 | 272 | 244 | 136 | 178 | 277 | 203 |

The APF triple mutant and APFF mutant were further compared for binding to DLL4 using the ECL Multispot Assay. The Fab antibodies were assayed at various concentrations to assess the dose dependence for binding to DLL4. The Fab antibodies also were assayed against various antigens to assess the specificity. The APFF mutant was tested in duplicate. Table 44 sets forth the signal/noise ratio for binding to DLL4. The results show that the H:APFF & L:wt mutant exhibits slightly increased affinity (70 nM) for DLL4 as compared to the H:APF & L:wt mutant (122 nM). Additionally, the results in Table 45, which depict the ECL signal observed in the assay, confirm that both Fab mutants specifically bind to DLL4 compared to other antigens tested.

TABLE 44

Binding affinity of Fab VH1-46_IGHD6-6*01_IGHJ1*01 S102A/S103P/S104F (APF) & L6_IGKJ1*01 versus Fab VH1-46_IGHD6-6*01_IGHJ1*01 S102A/S103P/S104F/H111F (APFF) & L6_IGKJ1*01

| Fab [nM] | Heavy Chain | | |
|---|---|---|---|
| | S102A/S103P/S104F (SEQ ID NO: 125) | S102A/S103P/S104F/H111F (SEQ ID NO: 126) | S102A/S103P/S104F/H111F (SEQ ID NO: 126) |
| | L6_IGKJ1*01 (SEQ ID NO: 107) | L6_IGKJ1*01 (SEQ ID NO: 107) Light Chain | L6_IGKJ1*01 (SEQ ID NO: 107) |
| | | Signal/Noise | |
| 500.00 | 65.9 | 47.3 | 54.8 |
| 50.00 | 207.3 | 239.1 | 355.7 |
| 5.00 | 260.4 | 747.6 | 282.9 |
| 0.50 | 46.9 | 87.6 | 36.6 |

TABLE 45

Binding affinity and specificity of Fab VH1-46_IGHD6-6*01_IGHJ1*01 S102A/S103P/S104F (APF) & L6_IGKJ1*01 versus Fab VH1-46_IGHD6-6*01_IGHJ1*01 S102A/S103P/S104F/H111F (APFF) & L6_IGKJ1*01

| | Fab [µM] | ErbB2 | EGF R | HGF R | Notch-1 | CD44 | IGF-1 | P-Cad | EPO R | DLL4 | Blank |
|---|---|---|---|---|---|---|---|---|---|---|---|
| S102A | 500.00 | 1578 | 1477 | 760 | 785 | 874 | 613 | 1008 | 1213 | 28930 | 439 |
| S103P | 50.00 | 672 | 585 | 525 | 509 | 557 | 558 | 652 | 768 | 80005 | 386 |
| S104F | 5.00 | 401 | 356 | 309 | 338 | 343 | 300 | 547 | 423 | 54938 | 211 |
| | 0.50 | 199 | 152 | 182 | 230 | 207 | 190 | 161 | 235 | 6666 | 142 |
| S102A | 500.00 | 908 | 2409 | 945 | 1607 | 1282 | 722 | 1011 | 4722 | 26937 | 570 |
| S103P | 50.00 | 394 | 452 | 368 | 559 | 449 | 283 | 349 | 736 | 79372 | 332 |
| S104F | 5.00 | 225 | 229 | 208 | 260 | 168 | 232 | 290 | 294 | 76254 | 102 |
| H111F | 0.50 | 130 | 137 | 104 | 158 | 129 | 94 | 106 | 122 | 8322 | 95 |
| S102A | 500.00 | 712 | 2895 | 723 | 1333 | 1143 | 736 | 785 | 4966 | 27150 | 495 |
| S103P | 50.00 | 503 | 552 | 380 | 470 | 550 | 485 | 453 | 879 | 79326 | 223 |
| S104F | 5.00 | 286 | 303 | 258 | 304 | 313 | 323 | 280 | 423 | 75810 | 268 |
| H111F | 0.50 | 222 | 266 | 215 | 265 | 279 | 184 | 201 | 298 | 7539 | 206 |

Example 9

Further Optimization of the Heavy Chain of Anti-DLL4 APFF Mutant for Binding to DLL4

In this Example, the heavy chain amino acid sequence of the APFF mutant that was affinity matured for binding to DLL4 as described in Examples 7 and 8, was used as a template for further mutations of other CDR regions of the antibody polypeptide. Mutant Fabs were expressed and assayed for binding to DLL4.

i. Alanine Scanning of CDR1

Heavy chain APFF mutant was used as a template for alanine scanning mutagenesis of amino acid residues in CDR1 (amino acids 26-35) to determine residues involved in antibody binding to DLL4. Alanine scanning was performed by mutating only residues T28, F29, T30, S31 and Y33 of CDR1 to an alanine. The mutant Fab antibodies were expressed and purified as described in Example 2 above.

Purified Fab alanine mutants were tested at a concentration of 10 nM for binding to DLL4 and other antigens using the ECL multispot binding assay. The results for the ECL assay are set forth in Tables 46 and 47. Table 46 sets forth the mutant Fabs and the Signal/Noise ratio for binding to DLL4. The results show that mutation of amino acid residues F29 and Y33 with alanine caused a reduction in the signal/noise ratio for binding to DLL4. Thus, these residues were not selected for further mutagenesis. Mutation of amino acid residues T28, T30 or S31 with alanine resulted in a slight increase in the signal/noise ratio for binding to DLL4 compared to the parent heavy chain APFF mutant. Table 47, which sets forth the ECL signal for binding to various antigens and to a blank well containing no antigen, shows that all antibodies tested exhibited specificity for DLL4. Table 46 also depicts the results of an ELISA assay performed as described in Example 6 using 100 nM of Fab mutant. The results of the ELISA also show that amino acid residue Y33 is involved in DLL4 binding. The differing results observed in the ECL assay compared to the ELISA are likely due to the fact that the ELISA assay selects for long off-rates whereas the ECL assay detects equilibrium binding. Therefore a mutant with a reduced on-rate but improved off rate can exhibit strong binding by ELISA, but it will not necessarily correlate to a strong ECL signal. In contrast, a mutant with an improved on-rate but reduced off rate can exhibit weak binding by ELISA.

A further experiment was performed to confirm binding of the alanine mutants to DLL4 using an ECL Assay. Table 48 sets forth the ECL signal for DLL4 antigen and blank and signal/ration of each mutant Fab for binding to DLL4. Table 40 sets forth the ECL signals of each mutant Fab for binding to all tested antigens. The results in Tables 48 and 49 confirm the ECL results observed in Tables 46 and 47, respectively.

TABLE 46

Binding of Fab heavy chain VH1-46_IGHD6-6*01_IGHJ1*01
S102A/S103P/S104F/H111F (APFF) & L6_IGKJ1 CDR1 alanine mutants
to DLL4

| Heavy Chain VH1-46_IGHD6-6*01_IGHJ1*01 | Fab SEQ ID NO | Light Chain (SEQ ID NO: 107) | ECL Signal/Noise [10 nM Fab] | ELISA (Signal-Noise) |
|---|---|---|---|---|
| S102A/S103P/S104F/H111F | 126 | L6_IGKJ1*01 | 202.2 | 0.78 |
| S102A/S103P/S104F/H111F T28A | 156 | L6_IGKJ1*01 | 334.0 | 0.77 |
| S102A/S103P/S104F/H111F F29A | 157 | L6_IGKJ1*01 | 189.8 | 0.67 |
| S102A/S103P/S104F/H111F T30A | 158 | L6_IGKJ1*01 | 456.9 | 0.64 |
| S102A/S103P/S104F/H111F S31A | 159 | L6_IGKJ1*01 | 453.3 | 0.47 |
| S102A/S103P/S104F/H111F Y33A | 160 | L6_IGKJ1*01 | 136.3 | 0.09 |

TABLE 47

Binding and specificity of Fab heavy chain VH1-46_IGHD6-6*01_IGHJ1*01
S102A/S103P/S104F/H111F (APFF) & L6_IGKJ1 CDR1 alanine mutants

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| APFF | 354 | 383 | 347 | 369 | 404 | 397 | 347 | 438 | 78437 | 388 |
| APFF T28A | 411 | 389 | 427 | 432 | 471 | 408 | 381 | 480 | 140295 | 420 |
| APFF F29A | 244 | 293 | 404 | 374 | 414 | 315 | 276 | 466 | 80652 | 425 |
| APFF T30A | 272 | 427 | 413 | 270 | 439 | 356 | 275 | 428 | 140273 | 307 |
| APFF S31A | 207 | 394 | 398 | 333 | 379 | 405 | 255 | 454 | 137810 | 304 |
| APFF Y33A | 394 | 372 | 345 | 244 | 294 | 308 | 383 | 373 | 26978 | 198 |

TABLE 48

Binding of Fab heavy chain VH1-46_IGHD6-6*01_IGHJ1*01
S102A/S103P/S104F/H111F (APFF) & L6_IGKJ1*01 CDR1 alanine mutants
to DLL4

| Heavy Chain VH1-46_IGHD6-6*01_IGHJ1*01 | Light Chain (SEQ ID NO: 107) | Signal | Blank | Signal/Noise |
|---|---|---|---|---|
| S102A/S103P/S104F/H111F T28A | L6_IGKJ1*01 | 181427 | 449 | 404.1 |
| S102A/S103P/S104F/H111F F29A | L6_IGKJ1*01 | 109225 | 459 | 238.0 |
| S102A/S103P/S104F/H111F T30A | L6_IGKJ1*01 | 177678 | 353 | 503.3 |
| S102A/S103P/S104F/H111F S31A | L6_IGKJ1*01 | 176308 | 333 | 529.5 |
| APFF | L6_IGKJ1*01 | 196536 | 283 | 694.5 |
| S102A/S103P/S104F/H111F Y33A | L6_IGKJ1*01 | 59547 | 265 | 224.7 |

TABLE 49

Binding and specificity of Fab heavy chain VH1-46_IGHD6-6*01_IGHJ1*01
S102A/S103P/S104F/H111F (APFF) & L6_IGKJ1*01 CDR1 alanine mutants

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| APFF T28A | 316 | 329 | 353 | 478 | 497 | 377 | 477 | 477 | 181427 | 449 |
| APFF F29A | 1292 | 537 | 512 | 6089 | 978 | 439 | 508 | 1055 | 109225 | 459 |
| APFF T30A | 408 | 351 | 353 | 368 | 396 | 343 | 337 | 479 | 177678 | 353 |
| APFF S31A | 253 | 377 | 358 | 427 | 235 | 268 | 262 | 507 | 176308 | 333 |
| APFF | 263 | 279 | 252 | 389 | 425 | 342 | 318 | 536 | 196536 | 283 |
| APFF Y33A | 298 | 281 | 248 | 334 | 290 | 227 | 178 | 430 | 59547 | 265 | ii. Alanine Scanning of CDR2

Heavy chain APFF mutant was used as a template for alanine scanning mutagenesis of amino acid residues in CDR2 (amino acids 50-66) to determine residues involved in antibody binding to DLL4. Amino acid residues Y60 to G66 were not mutated. The mutant Fab antibodies were expressed and purified as described in Example 2 above.

Purified Fab alanine mutants were tested at a concentration of 10 nM for binding to DLL4 using the ECL multispot binding assay. The results for the ECL assay are set forth in Tables 50 and 51. Table 50 sets forth the mutant Fabs and the Signal/Noise ratio for binding to DLL4. The results show that mutation of amino acid residues I50, G55, S57, T58, or S59 with alanine caused a reduction in the signal/noise ratio for binding to DLL4, and thus these residues were not further mutagenized. In contrast, mutation of amino acid residues I51, N52, P53, S54 or G56 with alanine improved the signal/noise ratio for binding to DLL4 2- to 4-fold over the parent heavy chain APFF mutant, and thus these residues were identified as residues for further mutagenesis. Table 51, which sets forth the ECL signals for binding various antigens and to a blank well containing no antigen, shows that all antibodies tested exhibited specificity for DLL4. Table 50 also depicts the results of an ELISA assay performed as described in Example 6 using 100 nM of Fab mutant. The results of the ELISA generally confirmed the results observed by the ECL assay. Mutation of amino acid residues I50, G55, S57, T58 and S59 exhibited decreased binding to DLL4 compared to the parent APFF mutant as observed by ELISA.

iii. NNK Mutagenesis of CDR2 Residues N52, S54 and G56

The Fab heavy chain APFF mutant was subsequently used as a template for further mutagenesis of amino acid residues N52, S54, G56 using NNK mutagenesis, as described above.

Fab heavy chain mutants containing mutations of amino acid residues N52, S65 and G56 in the parent APFF mutant template H:APFF & L:wt were tested for binding to DLL4 using the 96-well plate DLL4 ECL binding assay described in Example 4B and the ELISA assay described in Example 6. Table 52 depicts the ECL and ELISA signal for binding to DLL4 for the various mutants tested. Double mutants, such as I51T/N52V, were inadvertently generated during the PCR reaction. Several Fab mutants that contained a combination of two mutations at a specific amino acid position are designated as such. For example, G56E/D indicates the tested antibody was a mixture of two Fabs, one containing the mutation G56E and the other containing the mutation G56D. Both the ECL and ELISA results show that several Fab heavy chain mutants containing mutations in the Fab APFF mutant, including N52L, N52W, S54T, G56H and G56W, all bind DLL4 with greater affinity than the parent Fab APFF mutant.

TABLE 50

Binding of Fab heavy chain VH1-46_IGHD6-6*01_IGHJ1*01 S102A/S103P/S104F/H111F CDR1 and CDR2 alanine mutants to DLL4

| Heavy Chain VH1-46_IGHD6-6*01_IGHJ1*01 APFF | Fab SEQ ID NO 126 | Light Chain (SEQ ID NO: 107) L6_IGKJ1*01 | Signal/Noise [10 nM Fab] 202.2 | ELISA (Signal-Noise) 0.78 |
|---|---|---|---|---|
| S102A/S103P/S104F/H111F I50A | 161 | L6_IGKJ1*01 | 9.8 | 0.01 |
| S102A/S103P/S104F/H111F I51A | 162 | L6_IGKJ1*01 | 637.2 | 0.49 |
| S102A/S103P/S104F/H111F N52A | 163 | L6_IGKJ1*01 | 721.1 | 0.60 |
| S102A/S103P/S104F/H111F P53A | 164 | L6_IGKJ1*01 | 462.3 | 0.41 |
| S102A/S103P/S104F/H111F G55A | 166 | L6_IGKJ1*01 | 44.2 | 0.02 |
| S102A/S103P/S104F/H111F G56A | 167 | L6_IGKJ1*01 | 441.5 | 1.60 |
| S102A/S103P/S104F/H111F S57A | 168 | L6_IGKJ1*01 | 293.1 | 0.39 |
| S102A/S103P/S104F/H111F T58A | 169 | L6_IGKJ1*01 | 142.4 | 0.14 |
| S102A/S103P/S104F/H111F S59A | 170 | L6_IGKJ1*01 | 17.1 | 0.02 |
| S102A/S103P/S104F/H111F S54A | 165 | L6_IGKJ1*01 | 122.1 | 0.255 |
| APFF | 126 | L6_IGKJ1*01 | 71.1 | 0.123 |

TABLE 51

Binding and specificity of Fab heavy chain VH1-46_IGHD6-6*01_IGHJ1*01 S102A/S103P/S104F/H111F CDR1 and CDR2 alanine mutants

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| APFF | 354 | 383 | 347 | 369 | 404 | 397 | 347 | 438 | 78437 | 388 |
| I50A | 369 | 402 | 301 | 297 | 326 | 247 | 313 | 252 | 2668 | 271 |
| I51A | 344 | 373 | 440 | 312 | 391 | 383 | 144 | 380 | 159290 | 250 |
| N52A | 378 | 340 | 369 | 383 | 362 | 362 | 353 | 468 | 168745 | 234 |
| P53A | 203 | 439 | 337 | 393 | 378 | 374 | 390 | 427 | 151173 | 327 |
| G55A | 474 | 217 | 221 | 381 | 365 | 392 | 426 | 305 | 14500 | 328 |
| G56A | 279 | 355 | 313 | 331 | 330 | 422 | 214 | 466 | 189405 | 429 |
| S57A | 304 | 302 | 388 | 365 | 439 | 417 | 232 | 477 | 112266 | 383 |
| T58A | 320 | 384 | 304 | 289 | 318 | 271 | 294 | 329 | 47422 | 333 |
| S59A | 312 | 358 | 280 | 333 | 346 | 273 | 339 | 382 | 4502 | 264 |

TABLE 52

Binding of Fab VH1-46_IGHD6-6*01_IGHJ1*01 S102A/S103P/S104F/
H111F (APFF) & L6_IGKJ1*01 NNK heavy chain mutants to DLL4

| Fab | | ECL | ELISA |
|---|---|---|---|
| Heavy Chain VH1-46_IGHD6-6*01_IGHJ1*01 Mutant | SEQ ID NO | Light Chain (SEQ ID NO: 107) | Signal [10 nM Fab] | Signal [100 nM Fab] |
| S102A/S103P/S104F/H111F I51T/N52V | 171 | L6_IGKJ1*01 | 71708 | 1.23 |
| S102A/S103P/S104F/H111F N52G | 172 | L6_IGKJ1*01 | 55584 | 0.47 |
| S102A/S103P/S104F/H111F N52T | 173 | L6_IGKJ1*01 | 66771 | 0.61 |
| S102A/S103P/S104F/H111F N52P | 174 | L6_IGKJ1*01 | 44756 | 0.18 |
| APFF | 126 | L6_IGKJ1*01 | 42782 | 0.18 |
| S102A/S103P/S104F/H111F N52L | 175 | L6_IGKJ1*01 | 75452 | 1.06 |
| S102A/S103P/S104F/H111F N52W | 176 | L6_IGKJ1*01 | 87011 | 0.42 |
| S102A/S103P/S104F/H111F N52Y | 177 | L6_IGKJ1*01 | 24501 | 0.01 |
| S102A/S103P/S104F/H111F N52R | 183 | L6_IGKJ1*01 | 21642 | 0.01 |
| S102A/S103P/S104F/H111F N52V | 178 | L6_IGKJ1*01 | 64665 | 0.24 |
| S102A/S103P/S104F/H111F N52S | 179 | L6_IGKJ1*01 | 62211 | 0.28 |
| S102A/S103P/S104F/H111F N52Q | 180 | L6_IGKJ1*01 | 60646 | 0.10 |
| S102A/S103P/S104F/H111F N52K | 181 | L6_IGKJ1*01 | 67116 | 0.45 |
| S102A/S103P/S104F/H111F N52A | 163 | L6_IGKJ1*01 | 52534 | 0.12 |
| S102A/S103P/S104F/H111F G56V | 182 | L6_IGKJ1*01 | 68585 | 0.23 |
| S102A/S103P/S104F/H111F G56E/G | 241 | L6_IGKJ1*01 | 61039 | 0.21 |
| S102A/S103P/S104F/H111F G56V/N | 242 | L6_IGKJ1*01 | 68876 | 0.25 |
| S102A/S103P/S104F/H111F G56S | 184 | L6_IGKJ1*01 | 65728 | 0.18 |
| S102A/S103P/S104F/H111F G56K | 185 | L6_IGKJ1*01 | 66152 | 0.19 |
| S102A/S103P/S104F/H111F G56E/D | 243 | L6_IGKJ1*01 | 70474 | 0.24 |
| S102A/S103P/S104F/H111F G56T | 186 | L6_IGKJ1*01 | 60689 | 0.20 |
| S102A/S103P/S104F/H111F G56L | 187 | L6_IGKJ1*01 | 64709 | 0.12 |
| S102A/S103P/S104F/H111F G56A | 167 | L6_IGKJ1*01 | 63058 | 0.24 |
| APFF | 126 | L6_IGKJ1*01 | 51792 | 0.09 |
| S102A/S103P/S104F/H111F G56R | 188 | L6_IGKJ1*01 | 64277 | 0.20 |
| S102A/S103P/S104F/H111F G56H | 189 | L6_IGKJ1*01 | 68804 | 0.65 |
| S102A/S103P/S104F/H111F G56I | 190 | L6_IGKJ1*01 | 76973 | 0.23 |
| S102A/S103P/S104F/H111F G56L | 187 | L6_IGKJ1*01 | 63372 | 0.19 |
| S102A/S103P/S104F/H111F G56W | 191 | L6_IGKJ1*01 | 69571 | 0.54 |
| S102A/S103P/S104F/H111F G56A | 167 | L6_IGKJ1*01 | 65124 | 0.26 |
| S102A/S103P/S104F/H111F S54I | 192 | L6_IGKJ1*01 | 18450 | 0.03 |
| APFF | 126 | L6_IGKJ1*01 | 46641 | 0.07 |
| S102A/S103P/S104F/H111F S54E | 193 | L6_IGKJ1*01 | 36826 | 0.04 |
| S102A/S103P/S104F/H111F S54R | 194 | L6_IGKJ1*01 | 26284 | 0.02 |
| S102A/S103P/S104F/H111F S54G | 195 | L6_IGKJ1*01 | 47033 | 0.06 |
| S102A/S103P/S104F/H111F S54T | 196 | L6_IGKJ1*01 | 57232 | 0.08 |
| S102A/S103P/S104F/H111F S54L | 197 | L6_IGKJ1*01 | 28172 | 0.02 |
| S102A/S103P/S104F/H111F S54V | 198 | L6_IGKJ1*01 | 22155 | 0.00 |
| S102A/S103P/S104F/H111F S54Q | 264 | L6_IGKJ1*01 | 41757 | 0.07 |
| S102A/S103P/S104F/H111F S54A | 165 | L6_IGKJ1*01 | 32598 | 0.02 |
| S102A/S103P/S104F/H111F S54N | 199 | L6_IGKJ1*01 | 31710 | 0.02 |
| S102A/S103P/S104F/H111F S54P | 200 | L6_IGKJ1*01 | 10059 | 0.00 |
| S102A/S103P/S104F/H111F I50T/S54P | 201 | L6_IGKJ1*01 | 229 | 0.00 |
| S102A/S103P/S104F/H111F S54A | 165 | L6_IGKJ1*01 | 35277 | 0.02 |
| S102A/S103P/S104F/H111F S54A/S59N | 202 | L6_IGKJ1*01 | 17305 | 0.100 |
| APFF | 126 | L6_IGKJ1*01 | 42886 | 0.06 | iv. Further Mutagenesis of CDR2 Amino Acid Residue I51

A Fab mutant containing N52L, S54T and G56H was generated. Thus, the resulting Fab mutant contains seven mutations in the heavy chain of the antibody: S102A/S103P/S104F/H111F N52L/S54T/G56H, and is designated Fab mutant VH1-46_IGHD6-6*01_IGHJ1*01 S102A/S103P/S104F/H111F N52L/S54T/G56H & L6_IGKJ1*01 (H:APFF LTH & L:wt). The H:APFF LTH mutant was used as a template for further NNK mutagenesis of CDR2 amino acid residue I51. The I51 mutants were tested for binding to DLL4 using the 96-well plate ECL binding assay described in Example 4B and ELISA described in Example 6. The results are depicted in Table 53, which sets forth the ECL and ELISA signals. The results show that mutation of amino acid residue I51 to valine (I51V) in the H:APFF LTH parent backbone caused a further increase in binding affinity to DLL4 compared to the H:APFF LTH parent.

TABLE 53

Binding of Fab VH1-46_IGHD6-6*01_IGHJ1*01 S102A/S103P/S104F/H111F (APFF) & L6_IGKJ1*01 I51 NNK heavy chain mutants to DLL4

| Fab | | | ECL | ELISA |
|---|---|---|---|---|
| Heavy Chain VH1-46_IGHD6-6*01_IGHJ1*01 Mutant | SEQ ID NO | Light Chain (SEQ ID NO: 107) | Signal [10 nM Fab] | Signal [100 nM Fab] |
| S102A/S103P/S104F/H111F/ N52L/S54T/G56H (APFF LTH) | 203 | L6_IGKJ1*01 | 165312 | 1.101 |
| S102A/S103P/S104F/H111F/ I51A/N52L/S54T/G56H (APFF ALTH) | 204 | L6_IGKJ1*01 | 142542 | 0.620 |
| S102A/S103P/S104F/H111F/ I51T/N52L/S54T/G56H (APFF TLTH) | 205 | L6_IGKJ1*01 | 123199 | 0.641 |
| S102A/S103P/S104F/H111F/ I51Y/N52L/S54T/G56H (APFF YLTH) | 206 | L6_IGKJ1*01 | 154612 | 0.513 |
| S102A/S103P/S104F/H111F/ I51H/N52L/S54T/G56H (APFF HLTH) | 207 | L6_IGKJ1*01 | 155073 | 0.647 |
| S102A/S103P/S104F/H111F/ I51E/N52L/S54T/G56H (APFF ELTH) | 208 | L6_IGKJ1*01 | 166549 | 0.995 |
| S102A/S103P/S104F/H111F/ I51V/N52L/S54T/G56H (APFF VLTH) | 209 | L6_IGKJ1*01 | 192273 | 1.105 |
| S102A/S103P/S104F/H111F/ I51G/N52L/S54T/G56H (APFF GLTH) | 210 | L6_IGKJ1*01 | 130722 | 0.407 |
| S102A/S103P/S104F/H111F/ I51S/N52L/S54T/G56H (APFF SLTH) | 211 | L6_IGKJ1*01 | 134860 | 0.786 |
| S102A/S103P/S104F/H111F/ I51W/N52L/S54T/G56H (APFF WLTH) | 212 | L6_IGKJ1*01 | 126271 | 0.088 |
| S102A/S103P/S104F/H111F/ I51R/N52L/S54T/G56H (APFF RLTH) | 213 | L6_IGKJ1*01 | 92415 | 0.512 |
| S102A/S103P/S104F/H111F/ I51N/N52L/S54T/G56H (APFF NLTH) | 214 | L6_IGKJ1*01 | 125869 | 1.091 | v. NNK Mutagenesis of CDR2 Amino Acid Residue P53

Fab mutant VH1-46_IGHD6-6*01_IGHJ1*01 S102A/S103P/S104F/H111F I51T/N52L/S54T/G56H & L6_IGKJ1*01 (H:APFF TLTH) was used as a template for NNK mutagenesis of CDR2 amino acid residue P53. The P53 mutants were tested for binding to DLL4 using the 96-well plate ECL binding assay described in Example 4B and ELISA assay described in Example 6. Table 54 sets forth the ECL and ELISA signals. The results show that mutation of Fab VH1-46_IGHD6-6*01_IGHJ1*01 S102A/S103P/S104F/H111F I51T/N52L/S54T/G56H (H:APFF TLTH) & L6_IGKJ1*01 heavy chain residue P53 to alanine (P53A) causes an increase in binding affinity to DLL4 compared to the H:APFF TLTH mutant.

TABLE 54

Binding of Fab VH1-46_IGHD6-6*01_IGHJ1*01 S102A/S103P/S104F/H111F (APFF) & L6_IGKJ1*01 P53 NNK heavy chain mutants to DLL4

| Fab | | | ECL | ELISA |
|---|---|---|---|---|
| Heavy Chain VH1-46_IGHD6-6*01_IGHJ1*01 Mutant | SEQ ID NO | Light Chain (SEQ ID NO: 107) | Signal [10 nM Fab] | Signal [100 nM Fab] |
| S102A/S103P/S104F/H111F/ I51T/N52L/S54T/G56H (APFF TLTH) | 205 | L6_IGKJ1*01 | 123199 | 0.641 |

TABLE 54-continued

Binding of Fab VH1-46_IGHD6-6*01_IGHJ1*01 S102A/S103P/S104F/H111F
(APFF) & L6_IGKJ1*01 P53 NNK heavy chain mutants to DLL4

| Fab | | | ECL | ELISA |
|---|---|---|---|---|
| Heavy Chain<br>VH1-46_IGHD6-6*01_IGHJ1*01 Mutant | SEQ<br>ID<br>NO | Light Chain<br>(SEQ ID<br>NO: 107) | Signal<br>[10 nM<br>Fab] | Signal<br>[100 nM<br>Fab] |
| S102A/S103P/S104F/H111F/<br>I51T/N52L/P53V/S54T/G56H (APFF TLVTH) | 215 | L6_IGKJ1*01 | 91483 | 0.035 |
| S102A/S103P/S104F/H111F/<br>I51T/N52L/P53G/S54T/G56H (APFF TLGTH) | 216 | L6_IGKJ1*01 | 103398 | 0.018 |
| S102A/S103P/S104F/H111F/<br>I51T/N52L/P53S/S54T/G56H (APFF TLSTH) | 217 | L6_IGKJ1*01 | 135290 | 0.076 |
| S102A/S103P/S104F/H111F/<br>I51T/N52L/P53W/S54T/G56H<br>(APFF TLWTH) | 218 | L6_IGKJ1*01 | 126454 | 0.433 |
| S102A/S103P/S104F/H111F/<br>I51T/N52L/P53R/S54T/G56H (APFF TLRTH) | 219 | L6_IGKJ1*01 | 63200 | 0.070 |
| S102A/S103P/S104F/H111F/<br>I51T/N52L/P53N/S54T/G56H (APFF TLNTH) | 220 | L6_IGKJ1*01 | 113788 | 0.021 |
| S102A/S103P/S104F/H111F/<br>I51T/N52L/P53A/S54T/G56H (APFF<br>TLATH) | 221 | L6_IGKJ1*01 | 163025 | 0.330 |
| S102A/S103P/S104F/H111F/<br>I51T/N52L/P53T/S54T/G56H (APFF TLTTH) | 222 | L6_IGKJ1*01 | 124867 | 0.219 |
| S102A/S103P/S104F/H111F/<br>I51T/N52L/P53Y/S54T/G56H (APFF TLYTH) | 223 | L6_IGKJ1*01 | 99517 | 0.274 |
| S102A/S103P/S104F/H111F/<br>I51T/N52L/P53H/S54T/G56H (APFF TLHTH) | 224 | L6_IGKJ1*01 | 107908 | 0.287 |
| S102A/S103P/S104F/H111F/<br>I51T/N52L/P53E/S54T/G56H (APFF TLETH) | 225 | L6_IGKJ1*01 | 91504 | 0.017 |
| S102A/S103P/S104F/H111F/<br>I51T/N52L/P53M/S54T/G56H (APFF<br>TLMTH) | 226 | L6_IGKJ1*01 | 105485 | 0.341 |

Heavy chain mutants APFF LTH (SEQ ID NO:203), APFF ELTH (SEQ ID NO: 208), APFF VLTH (SEQ ID NO: 209), APFF NLTH (SEQ ID NO: 214), APFF TLATH (SEQ ID NO: 221) and APFF I51T/N52V (SEQ ID NO: 171) were each paired with parent light chain L6_IGKJ1*01 (SEQ ID NO:107) and further analyzed for binding to DLL4 by ELISA using 2-fold serial dilutions of Fab, starting at a concentration of 20 nM. The results are set forth in Table 55 below. The results show that Fabs containing heavy chain mutants APFF LTH (SEQ ID NO:206), APFF ELTH (SEQ ID NO: 208), APPF VLTH (SEQ ID NO: 209) and APFF NLTH (SEQ ID NO: 214) bind DLL4 with a Kd of approximately between 1 nM and 10 nM. Fabs containing heavy chain mutants APFF TLATH (SEQ ID NO: 221) and APFF I51T/N52V (SEQ ID NO:171) have lower affinity for DLL4 as compared to the other tested Fabs. Heavy chain mutant APFF TLATH has an approximate Kd greater than 100 nM and heavy chain mutant APFF I51T/N52V has a Kd between 10 and 100 nM.

TABLE 55

Heavy chain Fab mutant VH1-46_IGHD6-6*01_IGHJ1*01
S102A/S103P/S104F/H111F (APFF) & L6_IGKJ1*01 (SEQ
ID NO: 107) binding to DLL4 by ELISA

| Fab<br>[nM] | APFF<br>LTH | APFF<br>ELTH | APFF<br>VLTH | APFF<br>NLTH | APFF<br>TLATH | APFF<br>I51T/N52V |
|---|---|---|---|---|---|---|
| 20 | 2.402 | 2.290 | 2.052 | 1.627 | 1.109 | 0.648 |
| 10 | 2.345 | 2.168 | 1.854 | 1.362 | 0.875 | 0.506 |
| 5 | 2.477 | 2.333 | 2.198 | 1.751 | 1.272 | 0.724 |
| 2.5 | 2.151 | 1.982 | 1.656 | 1.165 | 0.592 | 0.358 |
| 1.3 | 0.653 | 0.402 | 0.252 | 0.143 | 0.078 | 0.055 |
| 0.63 | 1.367 | 1.010 | 0.785 | 0.419 | 0.227 | 0.115 |
| 0.31 | 2.402 | 2.290 | 2.052 | 1.627 | 1.109 | 0.648 |
| 0.16 | 2.345 | 2.168 | 1.854 | 1.362 | 0.875 | 0.506 | vi. NNK Mutagenesis of Framework Amino Acid Residue S84

Fab heavy chain APFF mutant was used as a template for further mutagenesis of amino acid residue S84 in the framework region of the heavy chain using overlapping PCR with NNK mutagenesis, as described above. The resulting mutants were tested for binding to DLL4 and other antigens using the ECL Multispot binding assay as described in Example 4A and ELISA as described in Example 6. The results for the ECL and ELISA are set forth in Tables 56. Table 56 sets forth mutant Fabs and the Signal/Noise ratio for binding to DLL4 by the ECL method or the ELISA assay. Table 57 sets forth the ECL signals of each mutant Fab for binding to all tested antigens. In general, the results show that Fab heavy chain VH1-46_IGHD6-6*01_IGHJ1*01 S102A/S103P/S104F/H111F S84 mutants showed no increase in binding to DLL4 by either ECL or ELISA. One mutant, Fab heavy chain VH1-46_IGHD6-6*01_IGHJ1*01 S102A/S103P/S104F/H111F S84T (SEQ ID NO:233), showed greater binding to DLL4 by the ECL MSD assay but had the same binding by ELISA.

TABLE 56

Binding of Fab heavy chain VH1-46_IGHD6-6*01_IGHJ1*01
S102A/S103P/S104F/H111F S84 NNK mutants to DLL4

| Fab | | | ELISA | |
|---|---|---|---|---|
| Heavy Chain VH1-46_IGHD6-6*01_IGHJ1*01 | SEQ ID NO | Light Chain (SEQ ID NO: 107) | Signal/Blank [10 nM Fab] | (Signal-Noise) |
| S102A/S103P/S104F/H111F S84G | 227 | L6_IGKJ1*01 | 346.1 | 0.53 |
| S102A/S103P/S104F/H111F S84Q | 228 | L6_IGKJ1*01 | 413.1 | 0.39 |
| S102A/S103P/S104F/H111F S84N | 229 | L6_IGKJ1*01 | 497.4 | 0.47 |
| S102A/S103P/S104F/H111F S84H | 230 | L6_IGKJ1*01 | 457.0 | 0.41 |
| S102A/S103P/S104F/H111F S84R | 231 | L6_IGKJ1*01 | 432.9 | 0.26 |
| S102A/S103P/S104F/H111F S84K | 232 | L6_IGKJ1*01 | 447.6 | 0.29 |
| S102A/S103P/S104F/H111F S84T | 233 | L6_IGKJ1*01 | 1079.0 | 0.40 |
| S102A/S103P/S104F/H111F | 126 | L6_IGKJ1*01 | 441.3 | 0.57 |
| S102A/S103P/S104F/H111F | 126 | L6_IGKJ1*01 | 309.9 | 0.24 |
| S102A/S103P/S104F/H111F | 126 | L6_IGKJ1*01 | 584.6 | 0.26 |
| S102A/S103P/S104F/H111F | 126 | L6_IGKJ1*01 | 718.7 | 0.37 |

TABLE 57

Binding and specificity of Fab heavy chain VH1-46_IGHD6-6*01_IGHJ1*01
S102A/S103P/S104F/H111F S84 NNK mutants

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| APFF S84G | 299 | 435 | 419 | 473 | 457 | 395 | 434 | 429 | 130821 | 378 |
| APFF S84Q | 311 | 347 | 255 | 416 | 372 | 373 | 357 | 288 | 122273 | 296 |
| APFF S84N | 307 | 337 | 375 | 309 | 251 | 324 | 167 | 415 | 134783 | 271 |
| APFF S84H | 301 | 306 | 374 | 331 | 382 | 353 | 319 | 318 | 138028 | 302 |
| APFF S84R | 372 | 435 | 392 | 377 | 335 | 395 | 310 | 393 | 139388 | 322 |
| APFF S84K | 354 | 301 | 317 | 400 | 386 | 405 | 517 | 528 | 164261 | 367 |
| APFF S84T | 297 | 293 | 274 | 372 | 352 | 281 | 180 | 328 | 162923 | 151 |
| APFF | 379 | 425 | 332 | 429 | 470 | 468 | 399 | 437 | 149144 | 338 |
| APFF | 292 | 329 | 237 | 377 | 326 | 357 | 277 | 449 | 126118 | 407 |
| APFF | 351 | 209 | 176 | 359 | 332 | 306 | 138 | 414 | 148493 | 254 |
| APFF | 322 | 409 | 263 | 417 | 316 | 173 | 240 | 328 | 132249 | 184 |

Example 10

Affinity Maturation of the Light Chain of Identified "Hit" Fab VH1-46_IGHD6-6*01_IGHJ1*01 & L6_IGKJ1*01 Against DLL4

In this Example, the light chain of parent "Hit" Fab VH1-46_IGHD6-6*01_IGHJ1*01 & L6_IGKJ1*01 against DLL4 was subjected to affinity maturation similar to the affinity maturation of the heavy chain as described in Examples 7-9 above.

i. Identification of the CDR Potential Binding Site

The amino acid sequence of the light chain (SEQ ID NO:107) for the "Hit" VH1-46_IGHD6-6*01_IGHJ1*01 & L6_IGKJ1*01 was aligned with the amino acid sequence of related light chains of three "non-Hits" that were identified as not binding to DLL4 (see Table 58 below) These four Fabs are related because they share the same $J_L$ germline segment.

Further, the $V_L$ germline segment is of the same subgroup (i.e. IGKV3). The sequence alignment is set forth in FIG. 2. Based on the alignment, amino acid residues were identified that differed between the "Hit" and "non-Hits," thus accounting for the differences in binding affinity of the "Hit" and "non-Hits." The identified amino acid residues were located in CDR3, which was identified as the region of the light chain that is important for binding affinity.

TABLE 58

"Hit" and "non-Hit" Antibodies for Light Chain Sequence Alignment

| Heavy Chain | SEQ ID NO | Light Chain | SEQ ID NO | ECL signal/blank |
|---|---|---|---|---|
| VH1-46_IGHD6-6*01_IGHJ1*01 | 88 | L6_IGKJ1*01 | 107 | 23.1 |
| VH1-46_IGHD6-6*01_IGHJ1*01 | 88 | A27_IGKJ1*01 | 110 | 1.3 |
| VH1-46_IGHD6-6*01_IGHJ1*01 | 88 | L25_IGKJ1*01 | 120 | 1.4 |
| VH1-46_IGHD6-6*01_IGHJ1*01 | 88 | L2_IGKJ1*01 | 112 | 1.4 |

NNK Mutagenesis of CDR3

Amino acid residues R91, S92, N93, and W94 of CDR3 of the light chain L6_IGKJ1*01 were mutated by NNK mutagenesis using overlapping PCR to further identify amino acid residues that are in binding to DLL4. CDR3 amino acid residues Q89, Q90, P95, P96, W97 and T98 were conserved among the four aligned light chains (see FIG. 2), and therefore were not subjected to NNK mutagenesis. Heavy chain triple mutant APF (see e.g. Example 7; Fab VH1-46_IGHD6-6*01_IGHJ1*01 S102A/S103P/S104F (H:APF) & L6_IGKJ1*01) was used as a parent template for NNK mutagenesis of amino acid residues R91 and S92. Heavy chain quadruple mutant APFF (see e.g., Example 9; Fab VH1-46_IGHD6-6*01_IGHJ1*01 S102A/S103P/S104F/H111F (H:APFF) & L6_IGKJ1*01) was used as a parent template for NNK mutagenesis of amino acid residues S92, N93 and W94. Amino acid mutations designated with X (for any amino acid) did not show appreciable binding and therefore were not sequenced to identify the exact mutation. The resulting mutants were assayed using the ECL multispot assay as described in Example 4A. The results are set forth in Tables 59 and 60 below Amino acid mutations designated with X (for any amino acid) did not show appreciable binding and therefore were not sequenced to identify the exact mutation. The results show that mutagenesis of amino acid residues R91, S92, N93 and W94 caused a reduction in ECL signal for binding to DLL4 compared either the APF or APFF parent template antibody, and therefore these residues were not further mutagenized.

TABLE 59

NNK mutagenesis of Fab VH1-46_IGHD6-6*01_IGHJ1*01 S102A/S103P/S104F (APF) (SEQ ID NO: 125) & L6_IGKJ1*01 or Fab VH1-46_IGHD6-6*01_IGHJ1*01 S102A/S103P/S104F/H111F (APFF) (SEQ ID NO: 126) & L6_IGKJ1*01 at light chain amino acid residues R91, S92, N93 and W94

| Fab Heavy Chain VH1-46_IGHD6-6*01_IGHJ1*01 | Light Chain L6_IGKJ1*01 | SEQ ID NO | Signal | Blank | Signal/Blank |
|---|---|---|---|---|---|
| S102A/S103P/S104F | R91P | 247 | 1280 | 271 | 4.7 |
| S102A/S103P/S104F | R91L | 248 | 375 | 273 | 1.4 |
| S102A/S103P/S104F | parent | 107 | 2585 | 229 | 11.3 |
| S102A/S103P/S104F | R91G | 249 | 292 | 209 | 1.4 |
| S102A/S103P/S104F | R91X | 361 | 1673 | 262 | 6.4 |
| S102A/S103P/S104F | parent | 107 | 2442 | 287 | 8.5 |
| S102A/S103P/S104F | R91Q | 250 | 817 | 261 | 3.1 |
| S102A/S103P/S104F | R91X | 361 | 248 | 296 | 0.8 |
| S102A/S103P/S104F | S92X | 362 | 180 | 259 | 0.7 |
| S102A/S103P/S104F | S92X | 362 | 255 | 395 | 0.6 |
| S102A/S103P/S104F | S92X | 362 | 2911 | 244 | 11.9 |
| S102A/S103P/S104F | parent | 107 | 2832 | 224 | 12.6 |
| S102A/S103P/S104F | S92N | 251 | 2092 | 271 | 7.7 |
| S102A/S103P/S104F | S92X | 362 | 701 | 140 | 5.0 |
| S102A/S103P/S104F | S92X | 362 | 2204 | 342 | 6.4 |
| S102A/S103P/S104F | S92C | 252 | 401 | 338 | 1.2 |
| S102A/S103P/S104F | parent | 107 | 3482 | 271 | 12.8 |
| S102A/S103P/S104F | parent | 107 | 2123 | 204 | 10.4 |
| S102A/S103P/S104F/H111F | N93Y | 253 | 1385 | 270 | 5.1 |
| S102A/S103P/S104F/H111F | N93S | 254 | 6436 | 206 | 31.2 |
| S102A/S103P/S104F/H111F | N93H | 255 | 14711 | 331 | 44.4 |
| S102A/S103P/S104F/H111F | N93Q | 256 | 704 | 239 | 2.9 |
| S102A/S103P/S104F/H111F | W94R | 257 | 75771 | 256 | 296.0 |
| S102A/S103P/S104F/H111F | W94S | 258 | 108653 | 479 | 226.8 |
| S102A/S103P/S104F/H111F | W94T | 259 | 23228 | 438 | 53.0 |
| S102A/S103P/S104F/H111F | W94L | 260 | 11613 | 200 | 58.1 |
| S102A/S103P/S104F/H111F | W94P | 261 | 332 | 169 | 2.0 |
| S102A/S103P/S104F/H111F | W94M | 262 | 33801 | 241 | 140.3 |
| S102A/S103P/S104F/H111F | S92P | 263 | 2412 | 292 | 8.3 |
| S102A/S103P/S104F/H111F | S92P | 263 | 446 | 166 | 2.7 |
| S102A/S103P/S104F/H111F | S92A/X | 363 | 1755 | 265 | 6.6 |
| S102A/S103P/S104F/H111F | S92Q | 265 | 348 | 255 | 1.4 |
| S102A/S103P/S104F/H111F | S92V | 266 | 327 | 317 | 1.0 |
| S102A/S103P/S104F/H111F | parent | 107 | 164982 | 282 | 585.0 |
| S102A/S103P/S104F/H111F | parent | 107 | 164992 | 277 | 595.6 |
| S102A/S103P/S104F/H111F | parent | 107 | 164224 | 274 | 599.4 |
| S102A/S103P/S104F/H111F | S92T | 267 | 54083 | 278 | 194.5 |
| S102A/S103P/S104F/H111F | S92C | 252 | 1343 | 348 | 3.9 |
| S102A/S103P/S104F/H111F | S92C | 252 | 1263 | 504 | 2.5 |
| S102A/S103P/S104F/H111F | S92C | 252 | 1229 | 428 | 2.9 |
| S102A/S103P/S104F/H111F | S92R | 252 | 418 | 252 | 1.7 |
| S102A/S103P/S104F/H111F | S92G | 269 | 89202 | 254 | 351.2 |
| S102A/S103P/S104F/H111F | S92V | 266 | 405 | 225 | 1.8 |
| S102A/S103P/S104F/H111F | S92M | 271 | 390 | 201 | 1.9 |
| S102A/S103P/S104F/H111F | S92N | 251 | 824 | 224 | 3.7 |
| S102A/S103P/S104F/H111F | S92G | 269 | 80151 | 294 | 272.6 |
| S102A/S103P/S104F/H111F | S92G | 269 | 80671 | 208 | 387.8 |
| S102A/S103P/S104F/H111F | parent | 107 | 188914 | 309 | 611.4 |
| S102A/S103P/S104F/H111F | S92R | 268 | 587 | 219 | 2.7 |
| S102A/S103P/S104F/H111F | S92P | 263 | 484 | 220 | 2.2 |
| S102A/S103P/S104F/H111F | S92P | 263 | 4751 | 296 | 16.1 |
| S102A/S103P/S104F/H111F | S92G | 269 | 91432 | 325 | 281.3 |

TABLE 60

NNK mutagenesis of Fab VH1-46_IGHD6-6*01_IGHJ1*01 S102A/S103P/S104F (APF) (SEQ
ID NO: 125) & L6_IGKJ1*01 or Fab VH1-46_IGHD6-6*01_IGHJ1*01 S102A/S103P/S104F/H111F
(APFF) (SEQ ID NO: 126) & L6_IGKJ1*01 at light chain amino acid residues R91, S92, N93 and W94

| Heavy Chain | Light Chain | ErbB2 | EGF R | HGF R | Notch-1 | CD44 | IGF-1 | P-Cad | EPO R | DLL4 | Blank |
|---|---|---|---|---|---|---|---|---|---|---|---|
| APF | R91P | 333 | 216 | 273 | 228 | 252 | 199 | 296 | 275 | 1280 | 271 |
| APF | R91L | 526 | 367 | 255 | 383 | 236 | 382 | 437 | 459 | 375 | 273 |
| APF | parent | 331 | 363 | 307 | 398 | 223 | 223 | 189 | 252 | 2585 | 229 |
| APF | R91G | 236 | 271 | 239 | 170 | 163 | 260 | 235 | 306 | 292 | 209 |
| APF | R91X | 268 | 329 | 279 | 297 | 254 | 282 | 180 | 193 | 1673 | 262 |
| APF | parent | 317 | 226 | 344 | 358 | 205 | 162 | 250 | 319 | 2442 | 287 |
| APF | R91Q | 234 | 290 | 325 | 229 | 268 | 210 | 314 | 263 | 817 | 261 |
| APF | R91X | 219 | 210 | 341 | 138 | 191 | 269 | 324 | 193 | 248 | 296 |
| APF | S92X | 262 | 163 | 260 | 82 | 228 | 208 | 176 | 208 | 180 | 259 |
| APF | S92X | 258 | 209 | 267 | 354 | 257 | 264 | 323 | 327 | 255 | 395 |
| APF | S92X | 257 | 306 | 334 | 272 | 270 | 216 | 326 | 220 | 2911 | 244 |
| APF | parent | 149 | 279 | 275 | 171 | 197 | 168 | 171 | 0 | 2832 | 224 |
| APF | S92N | 293 | 346 | 405 | 193 | 316 | 211 | 240 | 304 | 2092 | 271 |
| APF | S92X | 298 | 228 | 131 | 135 | 99 | 200 | 290 | 227 | 701 | 140 |
| APF | S92X | 248 | 300 | 333 | 243 | 279 | 247 | 266 | 309 | 2204 | 342 |
| APF | S92C | 295 | 143 | 335 | 125 | 156 | 303 | 265 | 302 | 401 | 338 |
| APF | parent | 330 | 272 | 306 | 257 | 189 | 241 | 297 | 304 | 3482 | 271 |
| APF | parent | 157 | 237 | 272 | 334 | 96 | 197 | 208 | 329 | 2123 | 204 |
| APFF | N93Y | 369 | 464 | 380 | 453 | 333 | 318 | 499 | 541 | 1385 | 270 |
| APFF | N93S | 351 | 364 | 328 | 345 | 346 | 238 | 321 | 420 | 6436 | 206 |
| APFF | N93H | 307 | 347 | 307 | 342 | 345 | 268 | 293 | 425 | 14711 | 331 |
| APFF | N93Q | 240 | 337 | 309 | 310 | 452 | 256 | 304 | 477 | 704 | 239 |
| APFF | W94R | 283 | 325 | 293 | 375 | 443 | 303 | 364 | 546 | 75771 | 256 |
| APFF | W94S | 351 | 419 | 453 | 486 | 469 | 450 | 466 | 506 | 108653 | 479 |
| APFF | W94T | 396 | 414 | 377 | 418 | 453 | 387 | 481 | 432 | 23228 | 438 |
| APFF | W94L | 274 | 257 | 187 | 369 | 309 | 263 | 296 | 333 | 11613 | 200 |
| APFF | W94P | 299 | 267 | 275 | 228 | 241 | 187 | 268 | 292 | 332 | 169 |
| APFF | W94M | 244 | 302 | 302 | 321 | 327 | 340 | 346 | 435 | 33801 | 241 |
| APFF | S92P | 219 | 345 | 242 | 346 | 282 | 236 | 354 | 391 | 2412 | 292 |
| APFF | S92P | 268 | 317 | 256 | 328 | 292 | 280 | 307 | 385 | 446 | 166 |
| APFF | S92A/X | 212 | 268 | 252 | 242 | 228 | 193 | 325 | 262 | 1755 | 265 |
| APFF | S92Q | 282 | 332 | 373 | 351 | 312 | 246 | 340 | 330 | 348 | 255 |
| APFF | S92V | 188 | 319 | 230 | 262 | 248 | 244 | 373 | 371 | 327 | 317 |
| APFF | parent | 259 | 290 | 321 | 380 | 346 | 249 | 302 | 1062 | 164982 | 282 |
| APFF | parent | 311 | 307 | 267 | 266 | 351 | 221 | 299 | 467 | 164992 | 277 |
| APFF | parent | 236 | 266 | 339 | 279 | 367 | 305 | 283 | 473 | 164224 | 274 |
| APFF | S92T | 237 | 295 | 290 | 231 | 290 | 308 | 387 | 424 | 54083 | 278 |
| APFF | S92C | 425 | 452 | 472 | 439 | 458 | 471 | 786 | 601 | 1343 | 348 |
| APFF | S92C | 573 | 638 | 616 | 611 | 646 | 666 | 930 | 845 | 1263 | 504 |
| APFF | S92C | 526 | 588 | 589 | 642 | 554 | 642 | 805 | 742 | 1229 | 428 |
| APFF | S92R | 272 | 292 | 265 | 386 | 365 | 248 | 387 | 318 | 418 | 252 |
| APFF | S92G | 274 | 273 | 238 | 296 | 263 | 229 | 213 | 405 | 89202 | 254 |
| APFF | S92V | 246 | 305 | 288 | 347 | 331 | 237 | 390 | 368 | 405 | 225 |
| APFF | S92M | 301 | 367 | 346 | 385 | 304 | 271 | 328 | 340 | 390 | 201 |
| APFF | S92N | 242 | 293 | 243 | 407 | 336 | 312 | 271 | 314 | 824 | 224 |
| APFF | S92G | 384 | 347 | 296 | 280 | 306 | 257 | 294 | 428 | 80151 | 294 |
| APFF | S92G | 228 | 160 | 314 | 203 | 284 | 297 | 238 | 418 | 80671 | 208 |
| APFF | parent | 289 | 326 | 185 | 310 | 211 | 336 | 295 | 433 | 188914 | 309 |
| APFF | S92R | 266 | 322 | 315 | 437 | 358 | 256 | 410 | 395 | 587 | 219 |
| APFF | S92P | 240 | 332 | 281 | 399 | 367 | 282 | 321 | 378 | 484 | 220 |
| APFF | S92P | 299 | 315 | 222 | 397 | 393 | 296 | 288 | 495 | 4751 | 296 |
| APFF | S92G | 377 | 420 | 287 | 541 | 413 | 323 | 402 | 543 | 91432 | 325 | iii. NNK Mutagenesis of CDR1

Amino acid residues S28, S30, S31, and Y32 of CDR1 of the light chain L6_IGKJ1*01 were mutated by NNK mutagenesis using overlapping PCR to further identify amino acid residues that are important for binding to DLL4. The APF triple mutant (see e.g. Example 7; Fab VH1-46_IGHD6-6*01_IGHJ1*01 S102A/S103P/S104F (H:APF) & L6_IGKJ1*01) was used as a template for NNK mutagenesis of S30 and Y32. The APFF heavy chain quadruple mutant (see e.g. Example 9; Fab VH1-46_IGHD6-6*01_IGHJ1*01 S102A/S103P/S104F/H111F (H:APFF) & L6_IGKJ1*01) was used as a template for NNK mutagenesis of S28, S30 and S31. The resulting mutants were assayed using the ECL multispot assay as described in Example 4A above. The results are set forth in Tables 61 and 62 below. Double mutants, such as R24G/Q27L, were inadvertently generated during the PCR reaction Amino acid mutations designated with X (for any amino acid) did not show appreciable binding and therefore were not sequenced to identify the exact mutation. The results show that mutagenesis of amino acid residue Y32 caused a reduction in binding affinity to DLL4 compared to the APF parent template, and therefore this residue was not further mutagenized. Mutagenesis of amino acid residue S28, S30 and S31 either improved binding affinity or did not affect binding affinity to DLL4 compared to the APF or APFF parent templates, and thus these residues were identified as residues for further mutagenesis. Three light chain mutants, namely L6_IGKJ1*01 S28D, S30N, and S31H, slightly increased antibody binding affinity to DLL4.

TABLE 61

NNK mutagenesis of Fab VH1-46_IGHD6-6*01_IGHJ1*01
S102A/S103P/S104F (APF) (SEQ ID NO: 125) & L6_IGKJ1*01 or Fab
VH1-46_IGHD6-6*01_IGHJ1*01 S102A/S103P/S104F/H111F (APFF) (SEQ ID
NO: 126) & L6_IGKJ1*01 at light chain amino acid residues S28, S30, S31 and Y32

| Heavy Chain VH1-46_IGHD6-6*01_IGHJ1*01 | Light Chain L6_IGKJ1*01 | SEQ ID NO | Signal | Blank | Signal/Blank |
|---|---|---|---|---|---|
| S102A/S103P/S104F | S30W | 300 | 791 | 186 | 4.3 |
| S102A/S103P/S104F | parent | 107 | 803 | 125 | 6.4 |
| S102A/S103P/S104F | S30X | 364 | 101 | 112 | 0.9 |
| S102A/S103P/S104F | S30R | 298 | 745 | 95 | 7.8 |
| S102A/S103P/S104F | S30X | 364 | 593 | 204 | 2.9 |
| S102A/S103P/S104F | S30T | 297 | 1016 | 206 | 4.9 |
| S102A/S103P/S104F | S30X | 364 | 1374 | 204 | 6.7 |
| S102A/S103P/S104F | S30X | 364 | 1299 | 210 | 6.2 |
| S102A/S103P/S104F | S30L | 296 | 1627 | 235 | 6.9 |
| S102A/S103P/S104F | Y32X | 365 | 648 | 196 | 3.3 |
| S102A/S103P/S104F | Y32X | 365 | 817 | 193 | 4.2 |
| S102A/S103P/S104F | Y32X | 365 | 1753 | 261 | 6.7 |
| S102A/S103P/S104F | Y32X | 365 | 1209 | 155 | 7.8 |
| S102A/S103P/S104F | R24G/Q27L | 276 | 197 | 87 | 2.3 |
| S102A/S103P/S104F | Y32V | 277 | 427 | 164 | 2.6 |
| S102A/S103P/S104F | Y32S | 278 | 1031 | 210 | 4.9 |
| S102A/S103P/S104F | parent | 107 | 4266 | 256 | 16.7 |
| S102A/S103P/S104F | Y32X | 365 | 293 | 253 | 1.2 |
| S102A/S103P/S104F | parent | 107 | 3052 | 242 | 12.6 |
| S102A/S103P/S104F/H111F | S28G | 279 | 182961 | 343 | 533.4 |
| S102A/S103P/S104F/H111F | S28K | 280 | 124246 | 395 | 314.5 |
| S102A/S103P/S104F/H111F | S28V | 281 | 83083 | 237 | 350.6 |
| S102A/S103P/S104F/H111F | S28F | 282 | 133659 | 249 | 536.8 |
| S102A/S103P/S104F/H111F | parent | 107 | 182026 | 400 | 455.1 |
| S102A/S103P/S104F/H111F | S28P | 244 | 178227 | 393 | 453.5 |
| S102A/S103P/S104F/H111F | S28T | 283 | 159288 | 305 | 522.3 |
| S102A/S103P/S104F/H111F | S28L | 284 | 72299 | 329 | 219.8 |
| S102A/S103P/S104F/H111F | S28Q | 285 | 133486 | 353 | 378.1 |
| S102A/S103P/S104F/H111F | S28A | 286 | 156761 | 332 | 472.2 |
| S102A/S103P/S104F/H111F | S28N | 287 | 203926 | 262 | 778.3 |
| S102A/S103P/S104F/H111F | S28H | 288 | 209433 | 344 | 608.8 |
| S102A/S103P/S104F/H111F | S28I | 289 | 106041 | 343 | 309.2 |
| S102A/S103P/S104F/H111F | S28R | 290 | 110363 | 449 | 245.8 |
| S102A/S103P/S104F/H111F | S28W | 291 | 165026 | 303 | 544.6 |
| S102A/S103P/S104F/H111F | S28M | 292 | 108166 | 322 | 335.9 |
| S102A/S103P/S104F/H111F | S28E | 293 | 184227 | 420 | 438.6 |
| S102A/S103P/S104F/H111F | S30C | 294 | 128661 | 915 | 140.6 |
| S102A/S103P/S104F/H111F | S30D | 295 | 225396 | 397 | 567.7 |
| S102A/S103P/S104F/H111F | S30L | 296 | 198641 | 379 | 524.1 |
| S102A/S103P/S104F/H111F | S30T | 297 | 122207 | 407 | 300.3 |
| S102A/S103P/S104F/H111F | S30R | 298 | 145575 | 416 | 349.9 |
| S102A/S103P/S104F/H111F | S30P | 299 | 1143 | 262 | 4.4 |
| S102A/S103P/S104F/H111F | parent | 107 | 207955 | 306 | 679.6 |
| S102A/S103P/S104F/H111F | S30W | 300 | 190872 | 289 | 660.5 |
| S102A/S103P/S104F/H111F | S30Y/S | 366 | 143412 | 294 | 487.8 |
| S102A/S103P/S104F/H111F | S30Q | 302 | 202637 | 198 | 1023.4 |
| S102A/S103P/S104F/H111F | S30A | 303 | 183649 | 356 | 515.9 |
| S102A/S103P/S104F/H111F | S30G | 304 | 180489 | 272 | 663.6 |
| S102A/S103P/S104F/H111F | S30N | 245 | 174926 | 352 | 496.9 |
| S102A/S103P/S104F/H111F | S30P | 299 | 1262 | 302 | 4.2 |
| S102A/S103P/S104F/H111F | S30G | 304 | 177646 | 351 | 506.1 |
| S102A/S103P/S104F/H111F | S30A | 303 | 186732 | 184 | 1014.8 |
| S102A/S103P/S104F/H111F | S30T | 297 | 136426 | 392 | 348.0 |
| S102A/S103P/S104F/H111F | S30V | 305 | 141111 | 284 | 496.9 |
| S102A/S103P/S104F/H111F | S30R | 298 | 189471 | 278 | 681.6 |
| S102A/S103P/S104F/H111F | S30Q | 302 | 196711 | 327 | 601.6 |
| S102A/S103P/S104F/H111F | S31T | 306 | 191253 | 332 | 576.1 |
| S102A/S103P/S104F/H111F | S31N | 307 | 177897 | 294 | 605.1 |
| S102A/S103P/S104F/H111F | S31K | 246 | 179257 | 511 | 350.8 |
| S102A/S103P/S104F/H111F | parent | 107 | 171775 | 442 | 388.6 |
| S102A/S103P/S104F/H111F | S31L | 308 | 155112 | 416 | 372.9 |
| S102A/S103P/S104F/H111F | S31M | 309 | 167080 | 442 | 378.0 |
| S102A/S103P/S104F/H111F | S31F | 310 | 188723 | 411 | 459.2 |
| S102A/S103P/S104F/H111F | S31I | 311 | 173649 | 321 | 541.0 |
| S102A/S103P/S104F/H111F | S31V | 312 | 176358 | 345 | 511.2 |
| S102A/S103P/S104F/H111F | S31H | 313 | 221327 | 264 | 838.4 |
| S102A/S103P/S104F/H111F | S31A | 314 | 192365 | 218 | 882.4 |
| S102A/S103P/S104F/H111F | S31P | 315 | 53282 | 341 | 156.3 |
| S102A/S103P/S104F/H111F | S31D | 316 | 154331 | 493 | 313.0 |
| S102A/S103P/S104F/H111F | S31R | 317 | 166188 | 298 | 557.7 |
| S102A/S103P/S104F/H111F | S31Y | 318 | 187896 | 284 | 661.6 |

TABLE 61-continued

NNK mutagenesis of Fab VH1-46_IGHD6-6*01_IGHJ1*01
S102A/S103P/S104F (APF) (SEQ ID NO: 125) & L6_IGKJ1*01 or Fab
VH1-46_IGHD6-6*01_IGHJ1*01 S102A/S103P/S104F/H111F (APFF) (SEQ ID
NO: 126) & L6_IGKJ1*01 at light chain amino acid residues S28, S30, S31 and Y32

| Heavy Chain VH1-46_IGHD6-6*01_IGHJ1*01 | Light Chain L6_IGKJ1*01 | SEQ ID NO | Signal | Blank | Signal/Blank |
|---|---|---|---|---|---|
| S102A/S103P/S104F/H111F | S31Q | 319 | 165030 | 407 | 405.5 |
| S102A/S103P/S104F/H111F | S31E | 320 | 171114 | 331 | 517.0 |
| S102A/S103P/S104F/H111F | S31G | 321 | 65521 | 231 | 283.6 |

TABLE 62

NNK mutagenesis of Fab VH1-46_IGHD6-6*01_IGHJ1*01 S102A/S103P/S104F (APF) (SEQ
ID NO: 125) & L6_IGKJ1*01 or Fab VH1-46_IGHD6-6*01_IGHJ1*01 S102A/S103P/S104F/H111F
(APFF) (SEQ ID NO: 126) & L6_IGKJ1*01 at light chain amino acid residues S28, S30, S31 and Y32

| Heavy Chain | Light Chain | ErbB2 | EGF R | HGF R | Notch-1 | CD44 | IGF-1 | P-Cad | EPO R | DLL4 | Blank |
|---|---|---|---|---|---|---|---|---|---|---|---|
| APF | S30W | 73 | 132 | 62 | 105 | 186 | 157 | 39 | 30 | 791 | 186 |
| APF | parent | 61 | 161 | 86 | 135 | 66 | 217 | 117 | 105 | 803 | 125 |
| APF | S30X | 119 | 67 | 75 | 45 | 6 | 56 | 83 | 93 | 101 | 112 |
| APF | S30R | 35 | 140 | 108 | 155 | 89 | 86 | 39 | 87 | 745 | 95 |
| APF | S30X | 319 | 99 | 122 | 231 | 239 | 144 | 224 | 227 | 593 | 204 |
| APF | S30T | 243 | 274 | 297 | 127 | 229 | 204 | 195 | 207 | 1016 | 206 |
| APF | S30X | 213 | 188 | 337 | 247 | 223 | 176 | 233 | 267 | 1374 | 204 |
| APF | S30X | 210 | 218 | 311 | 79 | 156 | 207 | 262 | 211 | 1299 | 210 |
| APF | S30L | 244 | 288 | 250 | 296 | 240 | 193 | 260 | 259 | 1627 | 235 |
| APF | Y32X | 240 | 223 | 259 | 241 | 203 | 170 | 199 | 248 | 648 | 196 |
| APF | Y32X | 155 | 93 | 176 | 148 | 147 | 142 | 38 | 190 | 817 | 193 |
| APF | Y32X | 125 | 240 | 299 | 168 | 236 | 247 | 260 | 214 | 1753 | 261 |
| APF | Y32X | 124 | 256 | 167 | 255 | 147 | 139 | 148 | 170 | 1209 | 155 |
| APF | R24G/Q27L | 225 | 252 | 185 | 177 | 119 | 49 | 236 | 191 | 197 | 87 |
| APF | Y32V | 156 | 57 | 283 | 56 | 120 | 151 | 186 | 144 | 427 | 164 |
| APF | Y32S | 154 | 208 | 222 | 137 | 162 | 175 | 51 | 230 | 1031 | 210 |
| APF | parent | 223 | 268 | 205 | 344 | 200 | 332 | 285 | 366 | 4266 | 256 |
| APF | Y32X | 275 | 266 | 358 | 306 | 206 | 304 | 382 | 374 | 293 | 253 |
| APF | parent | 383 | 296 | 265 | 107 | 273 | 132 | 366 | 254 | 3052 | 242 |
| APFF | S28G | 334 | 360 | 333 | 324 | 436 | 360 | 491 | 494 | 182961 | 343 |
| APFF | S28K | 270 | 386 | 355 | 395 | 464 | 348 | 443 | 477 | 124246 | 395 |
| APFF | S28V | 231 | 327 | 338 | 289 | 380 | 284 | 344 | 446 | 83083 | 237 |
| APFF | S28F | 242 | 283 | 223 | 367 | 402 | 275 | 336 | 413 | 133659 | 249 |
| APFF | parent | 333 | 406 | 432 | 350 | 451 | 386 | 368 | 539 | 182026 | 400 |
| APFF | S28P | 427 | 370 | 318 | 416 | 365 | 392 | 605 | 492 | 178227 | 393 |
| APFF | S28T | 271 | 321 | 371 | 249 | 368 | 355 | 676 | 380 | 159288 | 305 |
| APFF | S28L | 222 | 378 | 317 | 392 | 365 | 346 | 418 | 404 | 72299 | 329 |
| APFF | S28Q | 345 | 517 | 380 | 331 | 420 | 404 | 809 | 437 | 133486 | 353 |
| APFF | S28A | 348 | 351 | 377 | 440 | 502 | 378 | 521 | 424 | 156761 | 332 |
| APFF | S28N | 363 | 325 | 406 | 243 | 399 | 331 | 447 | 440 | 203926 | 262 |
| APFF | S28H | 381 | 435 | 346 | 482 | 513 | 355 | 447 | 517 | 209433 | 344 |
| APFF | S28I | 265 | 386 | 369 | 442 | 412 | 353 | 416 | 450 | 106041 | 343 |
| APFF | S28R | 318 | 403 | 378 | 425 | 378 | 437 | 395 | 542 | 110363 | 449 |
| APFF | S28W | 316 | 283 | 414 | 349 | 404 | 489 | 385 | 489 | 165026 | 303 |
| APFF | S28M | 271 | 320 | 305 | 382 | 313 | 341 | 410 | 360 | 108166 | 322 |
| APFF | S28E | 389 | 396 | 401 | 433 | 461 | 361 | 393 | 513 | 184227 | 420 |
| APFF | S30C | 1007 | 1187 | 1229 | 1472 | 1081 | 1027 | 1686 | 1792 | 128661 | 915 |
| APFF | S30D | 284 | 325 | 312 | 415 | 434 | 357 | 543 | 496 | 225396 | 397 |
| APFF | S30L | 270 | 406 | 315 | 389 | 295 | 332 | 351 | 540 | 198641 | 379 |
| APFF | S30T | 332 | 360 | 375 | 413 | 423 | 410 | 370 | 497 | 122207 | 407 |
| APFF | S30R | 434 | 456 | 458 | 576 | 455 | 404 | 465 | 571 | 145575 | 416 |
| APFF | S30P | 391 | 394 | 328 | 544 | 334 | 356 | 348 | 520 | 1143 | 262 |
| APFF | parent | 412 | 386 | 349 | 565 | 411 | 409 | 466 | 540 | 207955 | 306 |
| APFF | S30W | 289 | 398 | 399 | 372 | 500 | 471 | 342 | 542 | 190872 | 289 |
| APFF | S30Y/S | 319 | 299 | 345 | 306 | 346 | 283 | 429 | 520 | 143412 | 294 |
| APFF | S30Q | 262 | 353 | 339 | 243 | 400 | 342 | 298 | 423 | 202637 | 198 |
| APFF | S30A | 251 | 322 | 414 | 380 | 390 | 400 | 454 | 561 | 183649 | 356 |
| APFF | S30G | 404 | 387 | 355 | 382 | 427 | 393 | 369 | 485 | 180489 | 272 |
| APFF | S30N | 241 | 400 | 297 | 296 | 437 | 362 | 396 | 525 | 174926 | 352 |
| APFF | S30P | 358 | 385 | 383 | 346 | 411 | 312 | 413 | 418 | 1262 | 302 |
| APFF | S30G | 260 | 298 | 263 | 346 | 343 | 304 | 397 | 480 | 177646 | 351 |
| APFF | S30A | 295 | 337 | 311 | 364 | 451 | 342 | 317 | 475 | 186732 | 184 |
| APFF | S30T | 269 | 383 | 320 | 375 | 521 | 401 | 418 | 470 | 136426 | 392 |
| APFF | S30V | 279 | 412 | 394 | 294 | 375 | 365 | 333 | 536 | 141111 | 284 |
| APFF | S30R | 404 | 395 | 452 | 313 | 472 | 422 | 442 | 525 | 189471 | 278 |

TABLE 62-continued

NNK mutagenesis of Fab VH1-46_IGHD6-6*01_IGHJ1*01 S102A/S103P/S104F (APF) (SEQ
ID NO: 125) & L6_IGKJ1*01 or Fab VH1-46_IGHD6-6*01_IGHJ1*01 S102A/S103P/S104F/H111F
(APFF) (SEQ ID NO: 126) & L6_IGKJ1*01 at light chain amino acid residues S28, S30, S31 and Y32

| Heavy Chain | Light Chain | ErbB2 | EGF R | HGF R | Notch-1 | CD44 | IGF-1 | P-Cad | EPO R | DLL4 | Blank |
|---|---|---|---|---|---|---|---|---|---|---|---|
| APFF | S30Q | 340 | 381 | 344 | 326 | 411 | 354 | 393 | 376 | 196711 | 327 |
| APFF | S31T | 285 | 351 | 432 | 261 | 384 | 303 | 332 | 423 | 191253 | 332 |
| APFF | S31N | 197 | 246 | 300 | 267 | 384 | 379 | 342 | 363 | 177897 | 294 |
| APFF | S31K | 262 | 355 | 221 | 334 | 370 | 505 | 471 | 522 | 179257 | 511 |
| APFF | parent | 312 | 370 | 347 | 367 | 457 | 433 | 450 | 438 | 171775 | 442 |
| APFF | S31L | 288 | 375 | 319 | 365 | 371 | 405 | 346 | 427 | 155112 | 416 |
| APFF | S31M | 352 | 380 | 293 | 474 | 488 | 445 | 510 | 573 | 167080 | 442 |
| APFF | S31F | 295 | 342 | 280 | 349 | 256 | 267 | 369 | 599 | 188723 | 411 |
| APFF | S31I | 222 | 363 | 303 | 421 | 506 | 365 | 444 | 500 | 173649 | 321 |
| APFF | S31V | 300 | 363 | 288 | 374 | 384 | 335 | 360 | 509 | 176358 | 345 |
| APFF | S31H | 307 | 373 | 352 | 421 | 426 | 350 | 480 | 504 | 221327 | 264 |
| APFF | S31A | 383 | 415 | 309 | 424 | 406 | 334 | 361 | 461 | 192365 | 218 |
| APFF | S31P | 372 | 488 | 431 | 461 | 466 | 404 | 493 | 594 | 53282 | 341 |
| APFF | S31D | 479 | 438 | 429 | 510 | 471 | 407 | 451 | 596 | 154331 | 493 |
| APFF | S31R | 313 | 331 | 261 | 358 | 423 | 374 | 270 | 465 | 166188 | 298 |
| APFF | S31Y | 236 | 320 | 197 | 351 | 445 | 293 | 361 | 604 | 187896 | 284 |
| APFF | S31Q | 392 | 390 | 329 | 383 | 438 | 415 | 379 | 548 | 165030 | 407 |
| APFF | S31E | 313 | 297 | 324 | 460 | 390 | 367 | 273 | 441 | 171114 | 331 |
| APFF | S31G | 311 | 391 | 378 | 426 | 381 | 301 | 384 | 414 | 65521 | 231 |

Fab VH1-46_IGHD6-6*01_IGHJ1*01 S102A/S103P/S104F/H111F (H:APFF) & L6_IGKJ1*01 light chain mutants S28D, S28H, S30N and S31H were subsequently re-assayed for binding to DLL4 by ELISA. The results are set forth in Table 63 below. The results show that Fab VH1-46_IGHD6-6*01_IGHJ1*01 S102A/S103P/S104F/H111F (H:APFF) & L6_IGKJ1*01 light chain mutants S28N, and S31H slightly increase binding affinity to DLL4 compared to the H:APFF parental template antibody. By ELISA at the concentrations tested, the Fab VH1-46_IGHD6-6*01_IGHJ1*01 S102A/S103P/S104F/H111F (H:APFF) & L6_IGKJ1*01 light chain mutant S28H and S30D did not increase binding affinity to DLL4 compared to the APFF parental template antibody.

TABLE 63

Binding affinity of VH1-46_IGHD6-6*01_IGHJ1*01 S102A/S103P/S104F/H111F
(H: APFF) & L6_IGKJ1*01 Fab mutants to DLL4

Heavy Chain
S102A/S103P/S104F/H111F (SEQ ID NO: 126)
Light Chain

| | L6_IGKJ1*01 (SEQ ID NO: 107) | S28N (SEQ ID NO: 287) | S28H (SEQ ID NO: 288) | S30D (SEQ ID NO: 295) | L6_IGKJ1*01 (SEQ ID NO: 107) | S31H (SEQ ID NO: 313) |
|---|---|---|---|---|---|---|
| 400 nM | 0.13 | 0.19 | 0.13 | 0.13 | 0.13 | 0.20 |
| 200 nM | 0.10 | 0.17 | 0.14 | 0.11 | 0.08 | 0.11 |
| 100 nM | 0.07 | 0.13 | 0.09 | 0.09 | 0.07 | 0.09 |
| 50 nM | 0.06 | 0.07 | 0.05 | 0.06 | 0.04 | 0.05 |
| 25 nM | 0.02 | 0.04 | 0.03 | 0.03 | 0.02 | 0.03 |
| 25 nM | 0.03 | 0.05 | 0.03 | 0.03 | 0.02 | 0.03 |
| 0 | 0.00 | 0.00 | 0.01 | 0.00 | 0.00 | 0.00 |
| 0 | 0.00 | 0.00 | 0.00 | 0.01 | 0.01 | 0.00 | iv. Combination Mutants Based on NNK Mutagenesis of CDR1

Fab VH1-46_IGHD6-6*01_IGHJ1*01 S102A/S103P/S104F/H111F (H:APFF) & L6_IGKJ1*01 light chain mutants S28D, S30N and S31H were combined into one triple mutant, designated as Fab VH1-46_IGHD6-6*01_IGHJ1*01 S102A/S103P/S104F/H111F (H:APFF) & L6_IGKJ1*01 S28D/S30N/S31H (L:NDH) (H:APFF & L:NDH). The binding affinity of the H:APFF & L:NDH mutant to DLL4 was assayed using both ELISA and the 96-well plate ECL assay. Additionally, the light chain triple mutant L6_IGKJ1*01 S28D/S30N/S31H (L:NDH) was assayed in combination with heavy chain mutants VH1-46_IGHD6-6*01_IGHJ1*01 S102A/S103P/S104F/H111F/G56A (H:APFF G56A) and VH1-46_IGHD6-6*01_IGHJ1*01 S102A/S103P/S104F/H111F/S54A (H:APFF S54A).

The results are set forth in Tables 64 and 65 below. The results show the antibody mutant APFF-NDH binds DLL4 with 4-fold increased affinity as compared to parent antibody APFF mutant. The antibody Fab H:APFF G56A & L:NDH resulted in 8-fold greater affinity for binding to DLL4 as compared to the H:APFF & L:wt parental antibody mutant, and also exhibited increased binding affinity compared to the other antibodies tested. The antibody Fab H:APFF S54A & L:NDH resulted in a slight decrease in binding affinity compared to the H:APFF & L:NDH antibody mutant. Table 65 provides a comparison of binding affinity of antibodies containing the triple light chain mutant and various mutated heavy chain mutants. The results in Tables 64 and 65 show that the H:APFF G56A & L:NDH, containing 5 mutations in the heavy chain and three mutations in the light chain, exhibited the highest binding affinity of the antibodies tested.

TABLE 64

Binding affinity of VH1-46_IGHD6-6*01_IGHJ1*01 & L6_IGKJ1*01 Fab mutants

| | Heavy Chain | | | | |
|---|---|---|---|---|---|
| | APFF (SEQ ID NO: 126) | APFF (SEQ ID NO: 126) | APFF G56A (SEQ ID NO: 167) | APFF G56A (SEQ ID NO: 167) | APFF S54A (SEQ ID NO: 165) |
| | Light Chain | | | | |
| | Parent (SEQ ID NO: 107) | S28N/S30D/ S31H (SEQ ID NO: 323) | Parent (SEQ ID NO: 107) | S28N/S30D/ S31H (SEQ ID NO: 323) | S28N/S30D/ S31H (SEQ ID NO: 323) |
| 100 nM | 0.072 | 0.259 | 0.338 | 0.453 | 0.213 |
| 75 nM | 0.072 | 0.268 | 0.399 | 0.543 | 0.212 |
| 50 nM | 0.060 | 0.202 | 0.301 | 0.366 | 0.154 |
| 0 | 0.006 | 0.002 | 0.002 | 0.002 | 0.000 |

TABLE 65

Binding affinity of VH1-46_IGHD6-6*01_IGHJ1*01 & L6_IGKJ1*01 Fab mutants

| Fab | | | | ELISA |
|---|---|---|---|---|
| Heavy Chain VH1-46_IGHD6-6*01_IGHJ1*01 | SEQ ID NO | Light Chain L6_IGKJ1*01 | SEQ ID NO | ECL Signal [10 nM Fab] | Signal [100 nM Fab] |
| S102A/S103P/S104F/H111F | 126 | S28N/S30D/S31H | 323 | 48997 | 0.08 |
| S102A/S103P/S104F/H111F/G56A | 167 | S28N/S30D/S31H | 323 | 71603 | 0.20 |
| S102A/S103P/S104F/H111F/S54A | 165 | S28N/S30D/S31H | 323 | 46700 | 0.08 | v. Alanine Scanning of CDR2

Amino acid residues D50, A51, S52, N53, R54, A55 and T56 of CDR2 of the light chain L6_IGKJ1*01 were mutated by alanine scanning mutagenesis to further identify amino acid residues that are important for binding to DLL4 Amino acid residues A51 and A55 were mutated to threonine. The APFF heavy chain quadruple mutant (see e.g. Example 9; Fab VH1-46_IGHD6-6*01_IGHJ1*01 S102A/S103P/S104F/H111F (H:APFF) & L6_IGKJ1*01) was used as a template.

The results are set forth in Table 66 below. The results show that mutation of amino acid residues D50, R54 and T56 with alanine and substitution of amino acid residue A51 with threonine caused a reduction in ECL signal for binding to DLL4 and therefore these residues were not further mutagenized. Mutation of amino acid residues S52 and N53 with alanine and mutation of amino acid residue A55 with threonine either improved the ECL signal or did not affect the ECL signal for binding to DLL4 and therefore these residues were identified as amino acid residues for further mutagenesis.

TABLE 66

Binding affinity of Fab VH1-46_IGHD6-6*01_IGHJ1*01 S102A/S103P/S104F/H111F (APFF) & L6_IGKJ1*01 CDR2 alanine mutants

| Heavy Chain VH1-46_IGHD6-6*01_IGHJ1*01 | SEQ ID NO | Light Chain L6_IGKJ1*01 | SEQ ID NO | Signal [10 nM Fab] |
|---|---|---|---|---|
| S102A/S103P/S104F/H111F | 126 | wildtype | 107 | 13516 |
| S102A/S103P/S104F/H111F | 126 | D50A | 324 | 4231 |
| S102A/S103P/S104F/H111F | 126 | A51T | 325 | 2849 |
| S102A/S103P/S104F/H111F | 126 | S52A | 326 | 19311 |
| S102A/S103P/S104F/H111F | 126 | N53A | 327 | 14166 |
| S102A/S103P/S104F/H111F | 126 | R54A | 328 | 11626 |

TABLE 66-continued

Binding affinity of Fab VH1-46_IGHD6-6*01_IGHJ1*01 S102A/S103P/S104F/H111F (APFF) & L6_IGKJ1*01 CDR2 alanine mutants

| Heavy Chain VH1-46_IGHD6-6*01_IGHJ1*01 | SEQ ID NO | Light Chain L6_IGKJ1*01 | SEQ ID NO | Signal [10 nM Fab] |
|---|---|---|---|---|
| S102A/S103P/S104F/H111F | 126 | A55T | 329 | 13228 |
| S102A/S103P/S104F/H111F | 126 | T56A | 330 | 7260 | vi. NNK Mutagenesis of CDR2 Residues S52, N53, and A55

Fab mutant H:APFF & L:NDH (see Example 10 above; VH1-46_IGHD6-6*01_IGHJ1*01 S102A/S103P/S104F/H111F (H:APFF) & L6_IGKJ1*01 S28D/S30N/S31H (L:NDH)) was used as a template for NNK mutagenesis of CDR2 amino acid residues S52, N53 and A55. The Fab mutants were tested for binding to DLL4 using the 96-well plate ECL binding assay and ELISA. Table 67 sets forth the ECL and ELISA signals. Amino acid mutations designated with X (for any amino acid) did not show appreciable binding and therefore were not sequenced to identify the exact mutation. The results show that various mutants of H:APFF & L:NDH exhibited greater ECL and ELISA signals for binding to DLL4 as compared to the parental H:APFF & L:NDH, including those having further mutations S52T, S52L, N53H, A55S and A55G in the light chain.

Light chain mutants H:APFF & L:NDH S52T, H:APFF & L:NDH S52L, H:APFF & L:NDH S52T/S, H:APFF & L:NDH S52X, H:APFF & L:NDH N53H, H:APFF & L:NDH A55S and H:APFF & L:NDH A55G were further analyzed for binding to DLL4 by ELISA using 2-fold serial dilutions of Fab, starting at a concentration of 100 nM. The results are set forth in Table 68 below. Antibody mutants H:APFF & L:NDH S52L, H:APFF & L:NDH A55S and H:APFF & L:NDH A55G had a slightly increased affinity for binding to DLL4 as compared to the parental H:APFF & L:NDH mutant. All of the Fab light chain mutants bind DLL4 within the same range of affinity as the parental H:APFF & L:NDH mutant.

TABLE 67

Fab VH1-46_IGHD6-6*01_IGHJ1*01 S102A/S103P/S104F/H111F (H:APFF) & L6_IGKJ1*01 S28N/S30D/S31H (L:NDH) light chain CDR2 NNK mutant binding data

| Heavy Chain VH1-46_IGHD6-6*01_IGHJ1*01 (SEQ ID NO: 126) | Light Chain | SEQ ID NO | ECL Signal | ELISA (Avgerage signal-noise) |
|---|---|---|---|---|
| S102A/S103P/S104F/H111F | S28N/S30D/S31H S52L | 331 | 17810 | 0.285 |
| S102A/S103P/S104F/H111F | S28N/S30D/S31H S52G/V | 367 | 17589 | 0.233 |
| S102A/S103P/S104F/H111F | S28N/S30D/S31H S52T/S | 368 | 17769 | 0.261 |
| S102A/S103P/S104F/H111F | S28N/S30D/S31H S52R | 333 | 20009 | 0.244 |
| S102A/S103P/S104F/H111F | S28N/S30D/S31H S52S/Y | 369 | 15572 | 0.218 |
| S102A/S103P/S104F/H111F | S28N/S30D/S31H S52X | 370 | 2757 | 0.077 |
| S102A/S103P/S104F/H111F | S28N/S30D/S31H S52X | 370 | 15250 | 0.232 |
| S102A/S103P/S104F/H111F | S28N/S30D/S31H S52X | 370 | 16779 | 0.299 |
| S102A/S103P/S104F/H111F | S28N/S30D/S31H S52X | 370 | 16012 | 0.303 |
| S102A/S103P/S104F/H111F | S28N/S30D/S31H S52X | 370 | 15424 | 0.272 |
| S102A/S103P/S104F/H111F | S28N/S30D/S31H S52X | 370 | 16839 | 0.366 |
| S102A/S103P/S104F/H111F | S28N/S30D/S31H S52X | 370 | 15263 | 0.273 |
| S102A/S103P/S104F/H111F | S28N/S30D/S31H S52W | 334 | 16341 | 0.177 |
| S102A/S103P/S104F/H111F | S28N/S30D/S31H S52R | 333 | 20497 | 0.179 |
| S102A/S103P/S104F/H111F | NDH | 323 | 18697 | 0.165 |
| S102A/S103P/S104F/H111F | S28N/S30D/S31H S52N/X | 371 | 20512 | 0.221 |
| S102A/S103P/S104F/H111F | S28N/S30D/S31H S52R | 333 | 20573 | 0.243 |
| S102A/S103P/S104F/H111F | S28N/S30D/S31H S52P/X | 372 | 19361 | 0.233 |
| S102A/S103P/S104F/H111F | S28N/S30D/S31H S52T | 332 | 20097 | 0.263 |
| S102A/S103P/S104F/H111F | S28N/S30D/S31H S52M | 337 | 19458 | 0.185 |
| S102A/S103P/S104F/H111F | S28N/S30D/S31H N53X | 373 | 12235 | 0.106 |
| S102A/S103P/S104F/H111F | S28N/S30D/S31H N53E | 338 | 17553 | 0.204 |
| S102A/S103P/S104F/H111F | S28N/S30D/S31H N53X | 373 | 200 | 0.000 |
| S102A/S103P/S104F/H111F | S28N/S30D/S31H N53X | 373 | 9412 | 0.110 |
| S102A/S103P/S104F/H111F | S28N/S30D/S31H N53G | 339 | 20572 | 0.163 |
| S102A/S103P/S104F/H111F | S28N/S30D/S31H N53X | 373 | 15916 | 0.132 |
| S102A/S103P/S104F/H111F | S28N/S30D/S31H N53X | 373 | 3627 | −0.001 |
| S102A/S103P/S104F/H111F | S28N/S30D/S31H N53M | 340 | 17793 | 0.162 |
| S102A/S103P/S104F/H111F | S28N/S30D/S31H N53X | 373 | 13341 | 0.161 |
| S102A/S103P/S104F/H111F | S28N/S30D/S31H N53C/F | 374 | 18046 | 0.266 |
| S102A/S103P/S104F/H111F | S28N/S30D/S31H N53H | 342 | 20061 | 0.230 |
| S102A/S103P/S104F/H111F | S28N/S30D/S31H N53X | 373 | 14078 | 0.139 |
| S102A/S103P/S104F/H111F | S28N/S30D/S31H N53X | 373 | 456 | 0.060 |
| S102A/S103P/S104F/H111F | S28N/S30D/S31H N53M/L | 375 | 16809 | 0.166 |
| S102A/S103P/S104F/H111F | S28N/S30D/S31H N53P | 343 | 18132 | 0.120 |
| S102A/S103P/S104F/H111F | S28N/S30D/S31H N53X | 373 | 203 | 0.015 |
| S102A/S103P/S104F/H111F | S28N/S30D/S31H N53A | 344 | 14213 | 0.151 |
| S102A/S103P/S104F/H111F | S28N/S30D/S31H N53X | 373 | 14322 | 0.127 |
| S102A/S103P/S104F/H111F | S28N/S30D/S31H N53X | 373 | 260 | −0.001 |
| S102A/S103P/S104F/H111F | S28N/S30D/S31H A55R | 345 | 9031 | 0.106 |
| S102A/S103P/S104F/H111F | S28N/S30D/S31H A55C | 346 | 8226 | 0.146 |
| S102A/S103P/S104F/H111F | S28N/S30D/S31H A55X | 376 | 14187 | 0.202 |
| S102A/S103P/S104F/H111F | S28N/S30D/S31H A55S | 347 | 20047 | 0.383 |
| S102A/S103P/S104F/H111F | S28N/S30D/S31H A55X | 376 | 899 | 0.019 |
| S102A/S103P/S104F/H111F | S28N/S30D/S31H A55G | 348 | 21381 | 0.323 |
| S102A/S103P/S104F/H111F | S28N/S30D/S31H A55X | 376 | 8799 | 0.092 |
| S102A/S103P/S104F/H111F | S28N/S30D/S31H A55X | 376 | 5320 | 0.068 |
| S102A/S103P/S104F/H111F | NDH | 323 | 17201 | 0.214 |
| S102A/S103P/S104F/H111F | S28N/S30D/S31H A55X | 376 | 13643 | 0.116 |
| S102A/S103P/S104F/H111F | S28N/S30D/S31H A55X | 376 | 275 | 0.016 |
| S102A/S103P/S104F/H111F | S28N/S30D/S31H A55X | 376 | 1370 | 0.010 |
| S102A/S103P/S104F/H111F | S28N/S30D/S31H A55X | 376 | 13611 | 0.151 |
| S102A/S103P/S104F/H111F | S28N/S30D/S31H A55X | 376 | 167 | 0.007 |
| S102A/S103P/S104F/H111F | S28N/S30D/S31H A55G | 348 | 18042 | 0.301 |
| S102A/S103P/S104F/H111F | S28N/S30D/S31H A55X | 376 | 296 | 0.023 |
| S102A/S103P/S104F/H111F | S28N/S30D/S31H A55G | 348 | 19264 | 0.298 |
| S102A/S103P/S104F/H111F | S28N/S30D/S31H A55X | 376 | 5246 | 0.068 |

TABLE 68

Fab VH1-46_IGHD6-6*01_IGHJ1*01 S102A/S103P/S104F/H111F (APFF) (SEQ ID NO: 126) & L6_IGKJ1*01 S28N/S30D/S31H (NDH) light chain S52, N53 and A55 mutant binding to DLL4 by ELISA

| Fab [nM] | H L | APFF NDH/ S52L | APFF NDH/ S52T/S | APFF NDH/ S52X | APFF NDH/ S52T | APFF NDH/ N53H | APFF NDH/ A55S | APFF NDH/ A55G | APFF NDH |
|---|---|---|---|---|---|---|---|---|---|
| 100 | | 0.791 | 0.696 | 0.686 | 0.653 | 0.608 | 0.858 | 0.814 | 0.686 |
| 50 | | 0.546 | 0.500 | 0.508 | 0.490 | 0.416 | 0.588 | 0.510 | 0.507 |
| 25 | | 0.335 | 0.297 | 0.309 | 0.323 | 0.238 | 0.407 | 0.316 | 0.310 |
| 12.5 | | 0.215 | 0.186 | 0.192 | 0.215 | 0.167 | 0.258 | 0.198 | 0.192 |
| 6.25 | | 0.142 | 0.115 | 0.125 | 0.130 | 0.109 | 0.154 | 0.125 | 0.125 |
| 3.125 | | 0.095 | 0.088 | 0.096 | 0.099 | 0.089 | 0.108 | 0.093 | 0.096 | vii. NNK Mutagenesis of Framework 3 Residues S76 and F62

Fab VH1-46_IGHD6-6*01_IGHJ1*01 S102A/S103P/S104F/H111F (H:APFF) and L6_IGKJ1*01 was used as template for further mutagenesis of amino acid residues S76 and F62 in the framework 3 region of the light chain. These residues were mutated using overlapping PCR with NNK mutagenesis, as described above. Binding to DLL4 was assayed using an ECL Multispot assay as described in Example 4A or in an ELISA assay as described in Example 6. The results are set forth in Tables 69-71, below. The results show that mutation of amino acid residues S76 and F62 caused a decrease in the ECL and ELISA signals for binding to DLL4.

TABLE 69

Binding affinity of Fab VH1-46_IGHD6-6*01_IGHJ1*01 S102A/S103P/S104F/H111F (APFF) & L6_IGKJ1*01 S76 and F62 Mutants

| Heavy Chain VH1-46_IGHD6-6*01_IGHJ1*01 | SEQ ID NO | Light Chain L6_IGKJ1*01 | SEQ ID NO | Signal [10 nM Fab] |
|---|---|---|---|---|
| S102A/S103P/S104F/H111F | 126 | S76L | 351 | 13688 |
| S102A/S103P/S104F/H111F | 126 | S76T | 352 | 15747 |
| S102A/S103P/S104F/H111F | 126 | S76G | 353 | 13404 |
| S102A/S103P/S104F/H111F | 126 | wildtype | 107 | 13516 |
| S102A/S103P/S104F/H111F | 126 | S76A/K | 377 | 16525 |
| S102A/S103P/S104F/H111F | 126 | S76Y | 355 | 14825 |
| S102A/S103P/S104F/H111F | 126 | F62L | 356 | 261 |

TABLE 70

Binding affinity of Fab VH1-46_IGHD6-6*01_IGHJ1*01 S102A/S103P/S104F/H111F (H:APFF) & L6_IGKJ1*01 S76 and F62 Mutants

| Heavy Chain VH1-46_IGHD6-6*01_IGHJ1*01 | SEQ ID NO | Light Chain L6_IGKJ1*01 | SEQ ID NO | ECL Signal/ Noise | ELISA (Signal-Noise) |
|---|---|---|---|---|---|
| S102A/S103P/S104F/H111F | 126 | S76E | 357 | 217.5 | 0.36 |
| S102A/S103P/S104F/H111F | 126 | S76Q | 358 | 187.3 | 0.32 |
| S102A/S103P/S104F/H111F | 126 | S76P | 359 | 100.0 | 0.29 |
| S102A/S103P/S104F/H111F | 126 | S76N | 360 | 118.2 | 0.28 |
| S102A/S103P/S104F/H111F | 126 | wildtype | 107 | 441.3 | 0.57 |
| S102A/S103P/S104F/H111F | 126 | wildtype | 107 | 309.9 | 0.24 |
| S102A/S103P/S104F/H111F | 126 | wildtype | 107 | 584.6 | 0.26 |
| S102A/S103P/S104F/H111F | 126 | wildtype | 107 | 718.7 | 0.37 |

TABLE 71

Binding affinity and specificity of Fab VH1-46_IGHD6-6*01_IGHJ1*01 S102A/S103P/S104F/H111F (H:APFF) (SEQ ID NO: 126) & L6_IGKJ1*01 S76 and F62 Mutants

| Light | ErbB2 | EGF R | HGF R | Notch-1 | CD44 | IGF-1 | P-Cad | EPO R | DLL4 | Blank |
|---|---|---|---|---|---|---|---|---|---|---|
| S76E | 277 | 266 | 228 | 313 | 439 | 336 | 338 | 440 | 51555 | 237 |
| S76Q | 264 | 324 | 386 | 255 | 287 | 188 | 364 | 430 | 48330 | 258 |
| S76P | 260 | 331 | 394 | 402 | 313 | 347 | 271 | 371 | 29787 | 298 |
| S76N | 436 | 385 | 429 | 298 | 369 | 378 | 329 | 384 | 51989 | 440 |
| wildtype | 379 | 425 | 332 | 429 | 470 | 468 | 399 | 437 | 149144 | 338 |
| wildtype | 292 | 329 | 237 | 377 | 326 | 357 | 277 | 449 | 126118 | 407 |
| wildtype | 351 | 209 | 176 | 359 | 332 | 306 | 138 | 414 | 148493 | 254 |
| wildtype | 322 | 409 | 263 | 417 | 316 | 173 | 240 | 328 | 132249 | 184 |

Example 11

Heavy Chain and Light Chain Fab Combination Mutants

Heavy chain and light chain mutants that were identified in Examples 7-10 as contributing to binding to DLL4 were paired into various combination mutants. Heavy chain mutants included VH1-46_IGHD6-6*01_IGHJ1*01 S102A/S103P/S104F/H111F N52L/S54T/G56H (H:APFF LTH), VH1-46_IGHD6-6*01_IGHJ1*01 S102A/S103P/S104F/H111F I51A/N52L/S54T/G56H (H:APFF ALTH), and VH1-46_IGHD6-6*01_IGHJ1*01 S102A/S103P/S104F/H111F I51V/N52L/S54T/G56H (H:APFF VLTH). Light chain mutants included L6_IGKJ1*01 S28D/S30N/S31H S52L/A55S (L:NDH LS) and L6_IGKJ1*01 S28D/S30N/S31H S52L/A55G (L:NDH LG).

Table 72 below sets forth the Fabs and the ECL signal for binding to DLL4. In general, Fabs with H:APFF LTH and H:APFF VLTH heavy chains had an increased ECL signal for binding to DLL4 as compared to a Fab with a heavy chain H:APFF ALTH. Depending on the antibody tested, the particular light chain mutants also further affected binding to DLL4. Similar results were obtained by ELISA (Table 73). The mutants were further analyzed for binding to DLL4 by ELISA using 3-fold serial dilutions of Fab, starting at a concentration of 20 nM. The results are set forth in Table 73 below. Antibodies containing the H:APFF LTH and APFF H:VLTH heavy chain mutations had approximately 10-fold increased binding affinity to DLL4 compared to the antibody mutants containing the heavy chain mutant H:APFF ALTH.

TABLE 72

Fab VH1-46_IGHD6-6*01_IGHJ1*01 S102A/S103P/S104F/H111F (H:APFF) & L6_IGKJ1*01 S28N/S30D/S31H (L:NDH) CDR2 combination mutants

| Heavy Chain VH1-46_IGHD6-6*01_IGHJ1*01 S102A/S103P/S104F/H111F (APFF) | SEQ ID NO | Light Chain L6_IGKJ1*01 S28N/S30D/S31H (NDH) | SEQ ID NO | Fab ECL Signal |
|---|---|---|---|---|
| N52L/S54T/G56H (LTH) | 203 | (NDH) | 323 | 6023 |
| N52L/S54T/G56H (LTH) | 203 | S52L/A55G (NDH LG) | 349 | 9007 |
| N52L/S54T/G56H (LTH) | 203 | S52L/A55S (NDH LS) | 350 | 11493 |
| I51A/N52L/S54T/G56H (ALTH) | 204 | (NDH) | 323 | 1840 |
| I51A/N52L/S54T/G56H (ALTH) | 204 | S52L/A55G (NDH LG) | 349 | 1759 |
| I51A/N52L/S54T/G56H (ALTH) | 204 | S52L/A55S (NDH LS) | 350 | 3720 |
| I51V/N52L/S54T/G56H (VLTH) | 209 | (NDH) | 323 | 9789 |
| I51V/N52L/S54T/G56H (VLTH) | 209 | S52L/A55G (NDH LG) | 349 | 12246 |
| I51V/N52L/S54T/G56H (VLTH) | 209 | S52L/A55S (NDH LS) | 350 | 8000 |

TABLE 73

Fab VH5-51_IGHD5-18*01>3_IGHJ4*01 & V3-4_IGLJ*01 mutant binding to DLL4 by ELISA

| Heavy Chain VH1-46_IGHD6-6*01_IGHJ1*01 S102A/S103P/S104F/H111F (APFF) | Light Chain L6_IGKJ1*01 S28N/S30D/S31H (NDH) | 20 | 6.67 | 2.22 | 0.74 |
|---|---|---|---|---|---|
| N52L/S54T/G56H (LTH) | (NDH) | 0.863 | 0.739 | 0.463 | 0.270 |
| N52L/S54T/G56H (LTH) | S52L/A55G (NDH LG) | 1.008 | 0.880 | 0.594 | 0.368 |
| N52L/S54T/G56H (LTH) | S52L/A55S (NDH LS) | 1.054 | 0.916 | 0.557 | 0.398 |
| I51A/N52L/S54T/G56H (ALTH) | (NDH) | 0.391 | 0.232 | 0.069 | 0.024 |
| I51A/N52L/S54T/G56H (ALTH) | S52L/A55G (NDH LG) | 0.390 | 0.212 | 0.069 | 0.028 |
| I51A/N52L/S54T/G56H (ALTH) | S52L/A55S (NDH LS) | 0.458 | 0.282 | 0.040 | 0.046 |
| I51V/N52L/S54T/G56H (VLTH) | (NDH) | 0.979 | 0.776 | 0.608 | 0.288 |
| I51V/N52L/S54T/G56H (VLTH) | S52L/A55G (NDH LG) | 1.057 | 0.916 | 0.755 | 0.397 |
| I51V/N52L/S54T/G56H (VLTH) | S52L/A55S (NDH LS) | 0.910 | 0.747 | 0.523 | 0.263 |

Summary

As a result of affinity maturation, the affinity of parental Fab VH1-46_IGHD6-6*01_IGHJ1*01 & L6_IGKJ1*01 for binding to DLL4 was increased 430-fold. Table 75 below sets for the binding affinity of the various affinity matured antibodies for DLL4, as determined by SPR (see Example 5). Parent Fab VH1-46_IGHD6-6*01_IGHJ1*01 & L6_IGKJ1*01 binds DLL4 with a $K_D$ of 730 nM. Mutation of four heavy chain amino acids, namely S102A/S103P/S104F/H111F (H:APFF), resulted in a Fab with 10-fold increased affinity for DLL4 ($K_D$=70.6 nM). Affinity matured heavy and light chain mutant Fab H:APFF VLTH & L:NDH LS has a $K_D$ of 1.7 nM, a 430-fold increase in binding affinity for DLL4.

TABLE 75

Surface Plasmon Resonance Binding affinity of DLL4 Fabs

| Heavy Chain | Light Chain | $k_a$ (×10$^5$) (M$^{-1}$s$^{-1}$) | $k_d$ (s$^{-1}$) | $K_D$ (nM) |
|---|---|---|---|---|
| VH1-46_IGHD6-6*01_IGHJ1*01 (parental) | L6_IGKJ1*01 (parental) | 1.63 (±3) | 0.101 (±2) | 730 (±130) |
| VH1-46_IGHD6-6*01_IGHJ1*01 S104F | L6_IGKJ1*01 | 5.0 (±0.8) | 0.19 (±0.01) | 380 (±60) |
| VH1-46_IGHD6-6*01_IGHJ1*01 S102A/S103P/S104F (APF) | L6_IGKJ1*01 | 4.05 (±0.05) | 0.0492 (±0.0004) | 122 (±1) |
| VH1-46_IGHD6-6*01_IGHJ1*01 S102A/S103P/S104F/H111F (APFF) | L6_IGKJ1*01 | 4.25 (±0.04) | 0.0300 (±0.0002) | 70.6 (±0.7) |
| VH1-46_IGHD6-6*01_IGHJ1*01 S102A/S103P/S104F/H111Y (APFY) | L6_IGKJ1*01 | 3.40 (±0.03) | 0.0317 (±0.0002) | 93.1 (±0.9) |
| VH1-46_IGHD6-6*01_IGHJ1*01 S102A/S103P/S104F (APF) | L6_IGKJ1*01 S31K | 3.50 (±0.05) | 0.0392 (0.0004) | 112 (±2) |
| VH1-46_IGHD6-6*01_IGHJ1*01 S102A/S103P/S104F/H111F G56H (APFF G56H) | L6_IGKJ1*01 | 3.51 (±1.84) | 0.0101 (±0.000716) | 32.7 (±11.6) |
| VH1-46_IGHD6-6*01_IGHJ1*01 S102A/S103P/S104F/H111F (APFF) | L6_IGKJ1*01 S28N/S30D/S31H (NDH) | 4.44 | 0.0689 | *155.2 and 14 |
| VH1-46_IGHD6-6*01_IGHJ1*01 S102A/S103P/S104F/H111F I51V/N52L/S54T/G56H (APFF VLTH) | L6_IGKJ1*01 S28N/S30D/S31H (NDH) | 4.30 (±1.45) | 0.00113 (±0.000138) | 2.7 (±0.6) |
| VH1-46_IGHD6-6*01_IGHJ1*01 S102A/S103P/S104F/H111F I51V/N52L/S54T/G56H (APFF VLTH) | L6_IGKJ1*01 S28N/S30D/S31H S52L/A55S (NDH LS) | 6.84 (±2.51) | 0.00109 (±0.000106) | 1.7 (±0.5) |

*Fab Fab VH1-46_IGHD6-6*01_IGHJ1*01 S102A/S103P/S104F/H111F & L6_IGKJ1*01 S28N/S30D/S31H displays 2-site binding: 89% with Kd of 155.2 nM and 10% with Kd of 14 nM.

Example 12

Affinity Maturation of Identified Parent "Hit" Fab VH5-51_IGHD5-18*01>3_IGHJ4*01 & V3-4_IGLJ1*01 Against DLL4

The parent "Hit" Fab VH5-51_IGHD5-18*01>3_IGHJ4*01 & V3-4_IGLJ1*01 (SEQ ID NOS:89 and 108) against DLL4, identified in Example 4 using the electroluminescence Meso Scale Discovery (MSD) multi-spot binding assay, was subjected to affinity maturation as described above in Examples 7-11. By this method, an anti-DLL4 antibody was generated with significantly improved binding affinity for DLL4 compared to the parent "Hit" VH5-51_IGHD5-18*01>3_IGHJ4*01 & V3-4_IGLJ1*01 Fab antibody.

A. Heavy Chain

1. Identification of the CDR Potential Binding Site

The amino acid sequence of the heavy chain (SEQ ID NO:89) for the parent "Hit" VH5-51_IGHD5-18*01>3_IGHJ4*01 & V3-4_IGLJ1*01 was aligned with the amino acid sequence of a related heavy chain (SEQ ID NO:106) of a non-Hit that was identified as not binding to DLL4, i.e. VH5-51_IGHD6-25*01_IGHJ4*01. These two Fabs are related because they share the same $V_H$ and $J_H$ germline segments. The sequence alignment is set forth in FIG. 3. Based on the alignment, amino acid residues were identified that differed between the "Hit" and "non-Hit," thus accounting for the differences in binding of the "Hit" and "non-Hit" antibody for DLL4. The identified amino acid residues were located in CDR3, which was identified as the region of the heavy chain that is important for binding affinity.

2. Alanine Scanning of CDR3

Alanine scanning mutagenesis was performed on amino acid residues in the CDR3 of the heavy chain sequence of parent Fab VH5-51_IGHD5-18*01>3_IGHJ4*01 & V3-4_IGLJ1*01 to identify amino acid residues that do not appear to be involved in DLL4 binding. Alanine-scanning of the CDR3 region of the heavy chain was performed by mutating every residue of the CDR3 region to an alanine, except amino acid residues Y107, F108, D109, and Y110. Purified Fab alanine mutants were tested for binding to DLL4. The results are set forth in Table 76. Mutation of R99, Y101, S102, Y103, Y105, or D106 with alanine caused a reduction in the ECL signal for binding to DLL4, and therefore these residues were not further mutagenized. In contrast, mutation of G100 or G104 with alanine either resulted in an increased ECL signal or did not affect the ECL signal for binding to DLL4, and thus these residues were identified as residues for further mutagenesis. The results were confirmed in a repeat experiment using varying concentrations of mutant Fab and DLL4 protein (see Table 77).

TABLE 76

Fab VH5-51_IGHD5-18*01 > 3_IGHJ4*01 & V3-4_IGLJ1*01 alanine mutant binding data

| Heavy Chain VH5-51_IGHD5-18*01_IGHJ4*01 | SEQ ID NO | Light Chain | SEQ ID NO | Signal/Noise (0.04 μM) |
|---|---|---|---|---|
| wildtype | 89 | V3-4_IGLJ1*01 | 108 | 14.7 |
| R99A | 382 | V3-4_IGLJ1*01 | 108 | 1.3 |
| G100A | 383 | V3-4_IGLJ1*01 | 108 | 30.4 |
| Y101A | 384 | V3-4_IGLJ1*01 | 108 | 1.2 |
| S102A | 385 | V3-4_IGLJ1*01 | 108 | 2 |
| Y103A | 386 | V3-4_IGLJ1*01 | 108 | 1.2 |
| G104A | 387 | V3-4_IGLJ1*01 | 108 | 15.5 |

TABLE 76-continued

Fab VH5-51_IGHD5-18*01 > 3_IGHJ4*01 & V3-4_IGLJ1*01 alanine mutant binding data

| Heavy Chain VH5-51_IGHD5-18*01_IGHJ4*01 | SEQ ID NO | Light Chain | SEQ ID NO | Signal/ Noise (0.04 μM) |
|---|---|---|---|---|
| Y105A | 388 | V3-4_IGLJ1*01 | 108 | 9.6 |
| D106A | 389 | V3-4_IGLJ1*01 | 108 | 1.2 |
| wildtype | 89 | V3-4_IGLJ1*01 | 108 | 15.5 |

TABLE 77

Fab VH5-51_IGHD5-18*01 > 3_IGHJ4*01 & V3-4_IGLJ1*01 alanine mutant binding data

| Heavy Chain VH5-51_IGHD5-18*01_IGHJ4*01 | SEQ ID NO | Light Chain (SEQ ID NO: 108) | 0.1 μM Fab 30 μg/mL DLL4 Signal/Noise | 0.02 μM Fab 15 μg/mL DLL4 Signal/Noise |
|---|---|---|---|---|
| wildtype | 89 | V3-4_IGLJ1*01 | 24.0 | 15.2 |
| R99A | 382 | V3-4_IGLJ1*01 | 1.1 | 1.0 |
| G100A | 383 | V3-4_IGLJ1*01 | 53.3 | 24.2 |
| Y101A | 384 | V3-4_IGLJ1*01 | 1.1 | 1.3 |
| S102A | 385 | V3-4_IGLJ1*01 | 4.7 | 1.8 |
| Y103A | 386 | V3-4_IGLJ1*01 | 4.0 | 1.5 |
| G104A | 387 | V3-4_IGLJ1*01 | 41.5 | 12.5 |
| Y105A | 388 | V3-4_IGLJ1*01 | 1.0 | 1.0 |
| D106A | 389 | V3-4_IGLJ1*01 | 1.3 | 1.0 |

3. NNK Mutagenesis of Heavy Chain Amino Acid Residues G100 and G104

Following alanine scanning mutagenesis of CDR3, heavy chain amino acid residues G100 and G104 were selected for further mutation using overlapping PCR with NNK mutagenesis using wildtype Fab VH5-51_IGHD5-18*01>3_IGHJ4*01 & V3-4_IGLJ1*01 as a template, similar to the experiment described in Example 7.b.iii above. The results are set forth in Table 78 below Amino acid mutations designated with X (for any amino acid) did not show appreciable binding and therefore were not sequenced to identify the exact mutation. Two mutations, G100K and G104T, in the heavy chain were identified that resulted in a Fab with an improved ECL signal for binding to DLL4. Each mutant exhibited an ECL signal for binding to DLL4 approximately 2-fold greater than parent Fab VH5-51_IGHD5-18*01>3_IGHJ4*01 & V3-4_IGLJ1*01.

TABLE 78

NNK mutagenesis of parent Fab VH5-51_IGHD5-18*01 > 3_IGHJ4*01 & V3-4_IGLJ1*01 at amino acid residues G100 and G104

| Heavy Chain VH5-51_IGHD5-18*01_IGHJ4*01 | SEQ ID NO | Light Chain (SEQ ID NO: 108) | 0.1 μM Fab 30 μg/mL DLL4 Signal/Noise | 0.02 μM Fab 15 μg/mL DLL4 Signal/Noise |
|---|---|---|---|---|
| G100L | 390 | V3-4_IGLJ1*01 | 27.2 | 13.0 |
| G104stop | 436 | V3-4_IGLJ1*01 | 1.0 | 1.1 |
| G100L | 390 | V3-4_IGLJ1*01 | 66.2 | 32.5 |
| G100D | 391 | V3-4_IGLJ1*01 | 5.8 | 2.0 |
| G100T | 392 | V3-4_IGLJ1*01 | 26.0 | 11.0 |
| G100K | 378 | V3-4_IGLJ1*01 | 133.9 | 72.6 |
| G100R | 379 | V3-4_IGLJ1*01 | 90.6 | 39.9 |

TABLE 78-continued

NNK mutagenesis of parent Fab VH5-51_IGHD5-18*01 > 3_IGHJ4*01 & V3-4_IGLJ1*01 at amino acid residues G100 and G104

| Heavy Chain VH5-51_IGHD5-18*01_IGHJ4*01 | SEQ ID NO | Light Chain (SEQ ID NO: 108) | 0.1 μM Fab 30 μg/mL DLL4 Signal/Noise | 0.02 μM Fab 15 μg/mL DLL4 Signal/Noise |
|---|---|---|---|---|
| G100L | 390 | V3-4_IGLJ1*01 | 40.2 | 15.6 |
| G100L | 390 | V3-4_IGLJ1*01 | 59.0 | 28.7 |
| G104D | 393 | V3-4_IGLJ1*01 | 42.5 | 23.2 |
| G104A | 387 | V3-4_IGLJ1*01 | 6.7 | 2.6 |
| G104L | 394 | V3-4_IGLJ1*01 | 28.4 | 9.3 |
| G104P | 395 | V3-4_IGLJ1*01 | 1.0 | 1.0 |
| wildtype | 89 | V3-4_IGLJ1*01 | 31.4 | 13.2 |
| G104R | 396 | V3-4_IGLJ1*01 | 23.2 | 9.1 |
| G104T | 380 | V3-4_IGLJ1*01 | 45.4 | 20.2 |
| G104X | 437 | V3-4_IGLJ1*01 | 44.5 | 22.5 |
| G104T | 380 | V3-4_IGLJ1*01 | 63.2 | 29.0 |
| G104stop | 436 | V3-4_IGLJ1*01 | 1.2 | 0.9 |
| G104M | 397 | V3-4_IGLJ1*01 | 29.1 | 12.3 |
| wildtype | 89 | V3-4_IGLJ1*01 | 32.6 | 15.6 |
| G104L | 394 | V3-4_IGLJ1*01 | 23.4 | 10.8 |
| G104stop | 436 | V3-4_IGLJ1*01 | 1.0 | 1.0 |
| G104K | 398 | V3-4_IGLJ1*01 | 17.6 | 9.1 |
| wildtype | 89 | V3-4_IGLJ1*01 | 42.4 | 17.6 |
| G104R | 396 | V3-4_IGLJ1*01 | 20.4 | 7.8 |
| G104S | 399 | V3-4_IGLJ1*01 | 47.8 | 25.6 |
| G104R/Y101H | 400 | V3-4_IGLJ1*01 | 1.2 | 1.0 |
| G104T | 380 | V3-4_IGLJ1*01 | 67.8 | 35.8 |

4. Combination Mutant Based on NNK Mutagenesis of CDR3

Fab VH5-51_IGHD5-18*01>3_IGHJ4*01 & V3-4_IGLJ1*01 heavy chain mutants G100K and G104T, identified as having increased binding affinity to DLL4, were combined to generate a double mutant, designated as Fab VH5-51_IGHD5-18*01>3_IGHJ4*01 G100K/G104T & V3-4_IGLJ1*01 (H:KT). The binding of the KT double mutant to DLL4 was compared to the binding of the parent Fab VH5-51_IGHD5-18*01>3_IGHJ4*01 & V3-4_IGLJ1*01 to DLL4 by assaying various concentrations each antibody. The results are set forth in Tables 79-80 below. The results show that the KT double mutant exhibits an increased ECL signal for binding to DLL4 as compared to the parent Fab VH5-51_IGHD5-18*01>3_IGHJ4*01 & V3-4_IGLJ1*01. Both Fabs exhibit specific binding to DLL4 as compared to the various other tested antigens (see Table 80).

TABLE 79

Binding affinity of double mutant Fab VH5-51_IGHD5-18*01 > 3_IGHJ4*01 G100K/G104T & V3-4_IGLJ1*01 (SEQ ID NO: 108) as compared to wildtype Fab VH5-51_IGHD5-18*01 > 3_IGHJ4*01 & V3-4_IGLJ1*01

| Heavy Chain Fab [μM] | Wildtype (SEQ ID NO: 89) Signal | G100K, G104T (SEQ ID NO: 381) Signal | Wildtype (SEQ ID NO: 89) Signal/Noise | G100K, G104T (SEQ ID NO: 381) Signal/Noise |
|---|---|---|---|---|
| 200.00 | 4750 | 69079 | 36.3 | 76.9 |
| 20.00 | 2199 | 45123 | 21.1 | 157.2 |
| 2.00 | 443 | 5379 | 2.2 | 72.7 |
| 0.20 | 348 | 350 | 3.0 | 3.0 |

TABLE 80

Binding affinity and specificity of double mutant Fab VH5-51_IGHD5-18*01 > 3_IGHJ4*01 G100K/G104T & V3-4_IGLJ1*01 as compared to wildtype Fab VH5-51_IGHD5-18*01 > 3_IGHJ4*01 & V3-4_IGLJ1*01

| Heavy Chain | Fab [μM] | ErbB2 | EGF R | HGF R | Notch-1 | CD44 | IGF-1 | P-Cad | EPO R | DLL4 |
|---|---|---|---|---|---|---|---|---|---|---|
| Wt | 200.00 | 3.1 | 2.9 | 3.5 | 1.3 | 1.6 | 2.8 | 1.5 | 2.2 | 36.3 |
|  | 20.00 | 4.4 | 2.5 | 4.0 | 1.6 | 2.6 | 1.8 | 0.9 | 2.0 | 21.1 |
|  | 2.00 | 1.8 | 1.1 | 1.8 | 1.5 | 1.1 | 1.6 | 1.1 | 1.2 | 2.2 |
|  | 0.20 | 2.6 | 3.4 | 3.1 | 1.7 | 1.4 | 2.9 | 1.5 | 2.5 | 3.0 |
| G100K, G104T | 200.00 | 1.7 | 1.6 | 1.7 | 1.7 | 1.4 | 1.5 | 2.0 | 1.7 | 76.9 |
|  | 20.00 | 1.2 | 1.1 | 0.9 | 1.2 | 1.1 | 1.1 | 1.1 | 1.1 | 157.2 |
|  | 2.00 | 3.2 | 3.8 | 6.0 | 1.9 | 3.5 | 3.7 | 4.3 | 4.1 | 72.7 |
|  | 0.20 | 2.5 | 1.5 | 2.4 | 1.9 | 1.3 | 1.9 | 1.7 | 1.7 | 3.0 |

B. Further Optimization of the Heavy Chain

1. Summary

The heavy chain of the KT double mutant described and generated above was further optimized to improve its binding for DLL4. The heavy chain mutant KT double mutant was used as a template for further mutagenesis of heavy chain amino acid residues in the CDR1 (amino acids 26-35), CDR2 (amino acid residues 50-66) and framework region of the heavy chain by alanine scanning mutagenesis.

2. Alaninie Scanning of Residues in CDR1

Alanine scanning was performed by mutating every amino acid residue of CDR1, except G26. Three additional flanking amino acid residues, namely G24, I34, and G35 were also mutated to alanine. Purified Fab alanine mutants were tested for binding to DLL4 using the ECL multispot binding assay. The results are set forth in Tables 81-83 below. Mutation of amino acid residues Y27, F29, T30, S31, Y32, W33, or I34 with alanine caused a reduction in the ECL and ELISA signals for binding to DLL4, and thus these residues were not further mutagenized. Mutation of amino acid residues G24, S28, or G35 with alanine either improved the ECL signal or did not affect the ECL signal for binding to DLL4, and thus these residues were identified as residues for further mutagenesis. ELISA experiments also were performed, but little or no detectable signal was observed in the ELISA experiments (Table 81). Table 83 shows that the tested antibodies exhibit specificity for DLL4 compared to other tested antigens.

TABLE 81

Fab VH5-51_IGHD5-18*01 > 3_IGHJ4*01 G100K/G104T (KT) & V3-4_IGLJ1*01 CDR1 alanine mutant binding data

| Heavy Chain VH5-51_IGHD5-18*01_IGHJ4*01 | SEQ ID NO | Light Chain (SEQ ID NO: 108) | ECL Signal/ Blank | ELISA (Signal-Noise) |
|---|---|---|---|---|
| G100K/G104T G24A | 401 | V3-4_IGLJ1*01 | 122.1 | 0.02 |
| G100K/G104T I34A | 402 | V3-4_IGLJ1*01 | 2.6 | 0.01 |
| G100K/G104T G35A | 403 | V3-4_IGLJ1*01 | 180.5 | 0.02 |
| G100K/G104T S28A | 404 | V3-4_IGLJ1*01 | 112.1 | 0.01 |
| G100K/G104T | 381 | V3-4_IGLJ1*01 | 85.9 | 0.00 |
| G100K/G104T F29A | 405 | V3-4_IGLJ1*01 | 67.9 | 0.02 |
| G100K/G104T T30A | 406 | V3-4_IGLJ1*01 | 69.4 | 0.00 |
| G100K/G104T | 381 | V3-4_IGLJ1*01 | 188.0 | 0.00 |
| G100K/G104T W33A | 407 | V3-4_IGLJ1*01 | 3.0 | 0.02 |
| G100K/G104T | 381 | V3-4_IGLJ1*01 | 153.3 | 0.01 |

TABLE 82

Fab VH5-51_IGHD5-18*01 > 3_IGHJ4*01 G100K/G104T (KT) & V3-4_IGLJ1*01 CDR1 alanine mutant binding data

| Heavy Chain VH5-51_IGHD5-18*01_IGHJ4*01 | SEQ ID NO | Light Chain (SEQ ID NO: 108) | ECL Signal/ Blank |
|---|---|---|---|
| G100K/G104T | 381 | V3-4_IGLJ1*01 | 49.2 |
| G100K/G104T Y27A | 2899 | V3-4_IGLJ1*01 | 9.1 |
| G100K/G104T S31A | 2900 | V3-4_IGLJ1*01 | 3.0 |
| G100K/G104T Y32A | 2901 | V3-4_IGLJ1*01 | 2.7 |

TABLE 83

Fab VH5-51_IGHD5-18*01 > 3_IGHJ4*01 G100K/G104T (KT) & V3-4_IGLJ1*01 CDR1 alanine mutant binding data

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| KT G24A | 869 | 757 | 803 | 493 | 547 | 879 | 212 | 551 | 45546 | 373 |
| KT I34A | 1149 | 883 | 1084 | 564 | 608 | 923 | 349 | 505 | 772 | 300 |

TABLE 83-continued

Fab VH5-51_IGHD5-18*01 > 3_IGHJ4*01 G100K/G104T (KT) & V3-4_IGLJ1*01 CDR1 alanine mutant binding data

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| KT G35A | 911 | 760 | 939 | 400 | 624 | 899 | 305 | 506 | 53618 | 297 |
| KT S28A | 1072 | 839 | 1040 | 432 | 497 | 924 | 317 | 586 | 35439 | 316 |
| KT | 1095 | 852 | 838 | 543 | 579 | 877 | 319 | 554 | 36440 | 424 |
| KT F29A | 1040 | 887 | 985 | 601 | 621 | 945 | 502 | 586 | 22867 | 337 |
| KT T30A | 1071 | 853 | 868 | 539 | 698 | 968 | 438 | 553 | 24346 | 351 |
| KT | 1068 | 915 | 936 | 507 | 633 | 964 | 346 | 497 | 45120 | 240 |
| KT W33A | 921 | 761 | 735 | 561 | 513 | 788 | 302 | 424 | 731 | 240 |
| KT | 1098 | 768 | 867 | 437 | 540 | 781 | 226 | 421 | 32658 | 213 |

3. NNK Mutagenesis of Amino Acid Residues G24, S28 and G35

Following alanine scanning mutagenesis of CDR1, heavy chain amino acid residues G24, S28 and G35 were selected for further mutation using overlapping PCR with NNK mutagenesis using the heavy chain KT double mutant as a template. The results are set forth in Table 84 below Amino acid mutations designated with X (for any amino acid) did not show appreciable binding and therefore were not sequenced to identify the exact mutation. Several Fab mutants that contained a combination of two mutations at a specific amino acid position are designated as such. For example, G24S/T indicates the tested antibody was a mixture of two Fabs, one containing the mutation G24S and the other containing the mutation G24T. The results show that mutation of additional amino acids (G24L, S28R, S28K and G35V) in the heavy chain of the KT double mutant result in increase the ECL signal for binding to DLL4 compared to the parental KT double mutant template.

TABLE 84

Fab VH5-51_IGHD5-18*01 > 3_IGHJ4*01 G100K/G104T (KT) & V3-4_IGLJ1*01 CDR1 NNK mutant binding data

| Heavy Chain VH5-51_IGHD5-18*01_IGHJ4*01 | SEQ ID NO | Light Chain (SEQ ID NO: 108) | Fab ECL Signal | ELISA (Signal-Noise) |
|---|---|---|---|---|
| G100K/G104T G24L | 408 | V3-4_IGLJ1*01 | 19617 | 0.09 |
| G100K/G104T G24X | 438 | V3-4_IGLJ1*01 | 291 | 0.03 |
| G100K/G104T G24X | 438 | V3-4_IGLJ1*01 | 13304 | 0.06 |
| G100K/G104T G24X | 438 | V3-4_IGLJ1*01 | 250 | 0.03 |
| G100K/G104T G24X | 438 | V3-4_IGLJ1*01 | 10339 | 0.06 |
| G100K/G104T G24X | 438 | V3-4_IGLJ1*01 | 7395 | 0.05 |
| G100K/G104T G24X | 438 | V3-4_IGLJ1*01 | 1294 | 0.03 |
| G100K/G104T G24X | 438 | V3-4_IGLJ1*01 | 4299 | 0.04 |
| G100K/G104T G24X | 438 | V3-4_IGLJ1*01 | 319 | 0.02 |
| G100K/G104T G24S/T | 439 | V3-4_IGLJ1*01 | 22221 | 0.09 |
| G100K/G104T G24X | 438 | V3-4_IGLJ1*01 | 9771 | 0.06 |
| G100K/G104T G24X | 438 | V3-4_IGLJ1*01 | 7554 | 0.05 |
| G100K/G104T G24L/G | 440 | V3-4_IGLJ1*01 | 7970 | 0.05 |
| G100K/G104T G24X | 438 | V3-4_IGLJ1*01 | 517 | 0.04 |
| G100K/G104T G24X | 438 | V3-4_IGLJ1*01 | 1267 | 0.04 |
| G100K/G104T G24X | 438 | V3-4_IGLJ1*01 | 12665 | 0.05 |
| G100K/G104T G24X | 438 | V3-4_IGLJ1*01 | 12614 | 0.06 |
| G100K/G104T G24X | 438 | V3-4_IGLJ1*01 | 8746 | 0.05 |
| G100K/G104T G24X | 438 | V3-4_IGLJ1*01 | 2330 | 0.04 |
| G100K/G104T G24X | 438 | V3-4_IGLJ1*01 | 7003 | 0.05 |
| G100K/G104T S28R | 411 | V3-4_IGLJ1*01 | 36903 | 0.25 |
| G100K/G104T S28X | 441 | V3-4_IGLJ1*01 | 1882 | 0.06 |
| G100K/G104T S28K | 412 | V3-4_IGLJ1*01 | 32324 | 0.28 |
| G100K/G104T S28X | 441 | V3-4_IGLJ1*01 | 5811 | 0.06 |
| G100K/G104T G24R | 410 | V3-4_IGLJ1*01 | 4203 | 0.06 |
| G100K/G104T S28X | 441 | V3-4_IGLJ1*01 | 6855 | 0.05 |
| G100K/G104T S28X | 441 | V3-4_IGLJ1*01 | 356 | 0.03 |

TABLE 84-continued

Fab VH5-51_IGHD5-18*01 > 3_IGHJ4*01 G100K/G104T (KT) & V3-4_IGLJ1*01 CDR1 NNK mutant binding data

| Heavy Chain VH5-51_IGHD5-18*01_IGHJ4*01 | SEQ ID NO | Light Chain (SEQ ID NO: 108) | Fab ECL Signal | ELISA (Signal-Noise) |
|---|---|---|---|---|
| G100K/G104T S28X | 441 | V3-4_IGLJ1*01 | 8482 | 0.05 |
| G100K/G104T S28R | 411 | V3-4_IGLJ1*01 | 64124 | 0.49 |
| G100K/G104T S28X | 441 | V3-4_IGLJ1*01 | 14585 | 0.10 |
| G100K/G104T S28X | 441 | V3-4_IGLJ1*01 | 10205 | 0.07 |
| G100K/G104T S28X | 441 | V3-4_IGLJ1*01 | 834 | 0.04 |
| G100K/G104T S28X | 441 | V3-4_IGLJ1*01 | 4605 | 0.04 |
| G100K/G104T S28X | 441 | V3-4_IGLJ1*01 | 344 | 0.03 |
| G100K/G104T S28X | 441 | V3-4_IGLJ1*01 | 8017 | 0.05 |
| G100K/G104T S28X | 441 | V3-4_IGLJ1*01 | 9895 | 0.05 |
| G100K/G104T S28R | 411 | V3-4_IGLJ1*01 | 51418 | 0.29 |
| G100K/G104T S28N | 413 | V3-4_IGLJ1*01 | 17255 | 0.09 |
| G100K/G104T S28X | 441 | V3-4_IGLJ1*01 | 7681 | 0.05 |
| G100K/G104T G35X | 442 | V3-4_IGLJ1*01 | 6027 | 0.05 |
| G100K/G104T G35X | 442 | V3-4_IGLJ1*01 | 302 | 0.02 |
| G100K/G104T G35T | 414 | V3-4_IGLJ1*01 | 14452 | 0.07 |
| G100K/G104T G35X | 442 | V3-4_IGLJ1*01 | 937 | 0.04 |
| G100K/G104T G35X | 442 | V3-4_IGLJ1*01 | 4954 | 0.05 |
| G100K/G104T G35X | 442 | V3-4_IGLJ1*01 | 812 | 0.03 |
| G100K/G104T G35X | 442 | V3-4_IGLJ1*01 | 1088 | 0.04 |
| G100K/G104T G35X | 442 | V3-4_IGLJ1*01 | 1231 | 0.03 |
| G100K/G104T G35X | 442 | V3-4_IGLJ1*01 | 5067 | 0.04 |
| G100K/G104T G35A | 403 | V3-4_IGLJ1*01 | 19695 | 0.06 |
| G100K/G104T G35V | 416 | V3-4_IGLJ1*01 | 21169 | 0.09 |
| G100K/G104T G35X | 442 | V3-4_IGLJ1*01 | 2122 | 0.04 |
| G100K/G104T G35X | 442 | V3-4_IGLJ1*01 | 1426 | 0.04 |
| G100K/G104T G35X | 442 | V3-4_IGLJ1*01 | 326 | 0.03 |
| G100K/G104T G35X | 442 | V3-4_IGLJ1*01 | 3106 | 0.03 |
| G100K/G104T G35X | 442 | V3-4_IGLJ1*01 | 1373 | 0.03 |
| G100K/G104T G35X | 442 | V3-4_IGLJ1*01 | 5986 | 0.06 |
| G100K/G104T G35X | 442 | V3-4_IGLJ1*01 | 3787 | 0.04 |
| G100K/G104T G35X | 442 | V3-4_IGLJ1*01 | 4871 | 0.04 |
| G100K/G104T G35X | 442 | V3-4_IGLJ1*01 | 370 | 0.03 |
| G100K/G104T G35X | 442 | V3-4_IGLJ1*01 | 841 | 0.04 |

4. Combination Mutants of G24, S28 and G35

Fab VH5-51_JGHD5-18*01>3_IGHJ4*01 G100K/G104T (KT) & V3-4_IGLJ1*01 heavy chain mutants G24L, G24T, G24A, S28R and G35V were combined to generate antibodies containing three to five mutations in the heavy chain. The mutants generated are set forth in Table 85. The mutants were assessed for binding to DLL4 using an ECL assay. All combination mutants exhibited greater ECL signals for binding to DLL4 compared to the KT double mutant. The results show that the mutant Fab H:KT TRV & L:wt had the greatest affinity towards binding to DLL4.

TABLE 85

Fab VH5-51_IGHD5-18*01 > 3_IGHJ4*01 G100K/G104T (KT) &
V3-4_IGLJ1*01 CDR1 combination mutants

| Heavy Chain VH5-51_IGHD5-18*01_IGHJ4*01 | SEQ ID NO | Light Chain | SEQ ID NO | ECL Signal |
|---|---|---|---|---|
| G100K/G104T (KT) | 381 | V3-4_IGLJ1*01 | 108 | 588 |
| G100K/G104T/S28R (KT S28R) | 411 | V3-4_IGLJ1*01 | 108 | 6423 |
| G100K/G104T/G24L/S28R/G35V (KT LRV) | 417 | V3-4_IGLJ1*01 | 108 | 15333 |
| G100K/G104T/G24T/S28R/G35V (KT TRV) | 430 | V3-4_IGLJ1*01 | 108 | 26072 |
| G100K/G104T/G24A/S28R/G35V (KT ARV) | 431 | V3-4_IGLJ1*01 | 108 | 17357 |

5. Alanine Scanning of CDR2

The KT double mutant was used as a template for alanine scanning mutagenesis of CDR2 (amino acids 50-58) to determine residues important for antibody binding to DLL4. Purified Fab alanine mutants were tested for binding to DLL4 using the ECL multispot binding assay. The results are set forth in Tables 86-88 below. Mutation of amino acid residues I50, I51, Y52, P53, G54, D55, or D57 with alanine caused a reduction in the ECL signal for binding to DLL4, and thus these residues were not targeted for further mutagenesis. Substitution of amino acid residues S56 or T58 with alanine either improved the ECL signal or did not affect the ECL signal for binding to DLL4, and thus these residues were subjected to further mutagenesis. Similar experiments also were performed by ELISA, although little to no detectable signal was observed. Table 88 shows that all antibodies exhibit specificity for DLL4.

TABLE 86

Fab VH5-51_IGHD5-18*01 > 3_IGHJ4*01 G100K/G104T (KT) &
V3-4_IGLJ1*01 CDR2 alanine mutant binding data

| Heavy Chain VH5-51_IGHD5-18*01_IGHJ4*01 | SEQ ID NO | Light Chain (SEQ ID NO: 108) | ECL Signal/Blank | ELISA (Signal-Noise) |
|---|---|---|---|---|
| G100K/G104T D57A | 418 | V3-4_IGLJ1*01 | 2.8 | 0.01 |
| G100K/G104T | 381 | V3-4_IGLJ1*01 | 85.9 | 0.00 |
| G100K/G104T | 381 | V3-4_IGLJ1*01 | 188.0 | 0.00 |

TABLE 86-continued

Fab VH5-51_IGHD5-18*01 > 3_IGHJ4*01 G100K/G104T (KT) &
V3-4_IGLJ1*01 CDR2 alanine mutant binding data

| Heavy Chain VH5-51_IGHD5-18*01_IGHJ4*01 | SEQ ID NO | Light Chain (SEQ ID NO: 108) | ECL Signal/Blank | ELISA (Signal-Noise) |
|---|---|---|---|---|
| G100K/G104T | 381 | V3-4_IGLJ1*01 | 153.3 | 0.01 |
| G100K/G104T I50A | 419 | V3-4_IGLJ1*01 | 40.9 | 0.02 |
| G100K/G104T I51A | 420 | V3-4_IGLJ1*01 | 30.6 | 0.01 |
| G100K/G104T Y52A | 421 | V3-4_IGLJ1*01 | 2.7 | 0.04 |
| G100K/G104T P53A | 422 | V3-4_IGLJ1*01 | 57.7 | 0.00 |
| G100K/G104T D55A | 423 | V3-4_IGLJ1*01 | 2.5 | 0.00 |

TABLE 87

Fab VH5-51_IGHD5-18*01 > 3_IGHJ4*01 G100K/G104T (KT)
& V3-4_IGLJ1*01 CDR2 alanine mutant binding data

| Heavy Chain VH5-51_IGHD5-18*01_IGHJ4*01 | SEQ ID NO | Light Chain (SEQ ID NO: 108) | ECL Signal/Blank |
|---|---|---|---|
| G100K/G104T | 381 | V3-4_IGLJ1*01 | 49.2 |
| G100K/G104T G54A | 2902 | V3-4_IGLJ1*01 | 4.1 |
| G100K/G104T S56A | 2903 | V3-4_IGLJ1*01 | 55 |
| G100K/G104T T58A | 425 | V3-4_IGLJ1*01 | 101.9 |

TABLE 88

Fab VH5-51_IGHD5-18*01 > 3_IGHJ4*01 G100K/G104T (KT) &
V3-4_IGLJ1*01 CDR1 and CDR2 alanine mutant binding data

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| KT D57A | 1203 | 915 | 1126 | 523 | 600 | 982 | 365 | 456 | 888 | 321 |
| KT | 1095 | 852 | 838 | 543 | 579 | 877 | 319 | 554 | 36440 | 424 |
| KT | 1068 | 915 | 936 | 507 | 633 | 964 | 346 | 497 | 45120 | 240 |
| KT | 1098 | 768 | 867 | 437 | 540 | 781 | 226 | 421 | 32658 | 213 |
| KT I50A | 925 | 794 | 822 | 443 | 632 | 785 | 343 | 523 | 9682 | 237 |
| KT I51A | 1092 | 803 | 875 | 612 | 517 | 828 | 432 | 497 | 6578 | 215 |
| KT Y52A | 989 | 745 | 803 | 566 | 591 | 827 | 334 | 584 | 735 | 277 |
| KT P53A | 1145 | 976 | 1000 | 536 | 556 | 943 | 424 | 563 | 20135 | 349 |
| KT D55A | 1028 | 729 | 856 | 683 | 606 | 898 | 310 | 479 | 761 | 306 |

6. NNK Mutagenesis of Amino Acid Residues T58 and S56

Following alanine scanning mutagenesis of CDR2, heavy chain amino acid residues T58 and S56 were selected for further mutation using overlapping PCR with NNK mutagenesis using the H:KT & L:wt double mutant as a template. The results are set forth in Table 89 below Amino acid mutations designated with X (for any amino acid) did not show appreciable binding and therefore were not sequenced to identify the exact mutation. Mutation of heavy chain KT amino acid residue T58 to alanine (T58A) and aspartic acid (T58D) resulted in an increase in ECL signal for binding to DLL4.

TABLE 89

Fab VH5-51_IGHD5-18*01 > 3_IGHJ4*01 G100K/G104T (H:KT) & V3-4_IGLJ1*01 CDR1 and CDR2 T58 and S56 NNK mutant binding data

| Heavy Chain VH5-51_IGHD5-18*01_IGHJ4*01 | SEQ ID NO | Light Chain (SEQ ID NO: 108) | ECL Signal | ELISA (Signal-Noise) |
|---|---|---|---|---|
| G100K/G104T T58D/K | 443 | V3-4_IGLJ1*01 | 823 | 0.03 |
| G100K/G104T/T58X | 444 | V3-4_IGLJ1*01 | 5040 | 0.03 |
| G100K/G104T/T58X | 444 | V3-4_IGLJ1*01 | 765 | 0.03 |
| G100K/G104T/T58X | 444 | V3-4_IGLJ1*01 | 520 | 0.02 |
| G100K/G104T/T58A | 425 | V3-4_IGLJ1*01 | 12938 | 0.07 |
| G100K/G104T/T58X | 444 | V3-4_IGLJ1*01 | 2272 | 0.03 |
| G100K/G104T/T58X | 444 | V3-4_IGLJ1*01 | 1059 | 0.03 |
| G100K/G104T/T58X | 444 | V3-4_IGLJ1*01 | 619 | 0.03 |
| G100K/G104T/T58X | 444 | V3-4_IGLJ1*01 | 2994 | 0.04 |
| G100K/G104T/T58X | 444 | V3-4_IGLJ1*01 | 7341 | 0.05 |
| G100K/G104T/T58X | 444 | V3-4_IGLJ1*01 | 1422 | 0.03 |
| G100K/G104T/T58X | 444 | V3-4_IGLJ1*01 | 5119 | 0.05 |
| G100K/G104T/T58D | 424 | V3-4_IGLJ1*01 | 11468 | 0.07 |
| G100K/G104T/T58D | 424 | V3-4_IGLJ1*01 | 10459 | 0.06 |
| G100K/G104T/T58X | 444 | V3-4_IGLJ1*01 | 476 | 0.03 |
| G100K/G104T/T58X | 444 | V3-4_IGLJ1*01 | 1421 | 0.03 |
| G100K/G104T/T58X | 444 | V3-4_IGLJ1*01 | 658 | 0.03 |
| G100K/G104T/T58X | 444 | V3-4_IGLJ1*01 | 4278 | 0.03 |
| G100K/G104T/S56X | 445 | V3-4_IGLJ1*01 | 1436 | 0.04 |
| G100K/G104T/S56X | 445 | V3-4_IGLJ1*01 | 1553 | 0.03 |
| G100K/G104T/S56X | 445 | V3-4_IGLJ1*01 | 1372 | 0.04 |
| G100K/G104T/S56X | 445 | V3-4_IGLJ1*01 | 585 | 0.03 |
| G100K/G104T/S56X | 445 | V3-4_IGLJ1*01 | 1165 | 0.03 |
| G100K/G104T/S56X | 445 | V3-4_IGLJ1*01 | 335 | 0.03 |
| G100K/G104T/S56X | 445 | V3-4_IGLJ1*01 | 1139 | 0.04 |
| G100K/G104T/S56X | 445 | V3-4_IGLJ1*01 | 3206 | 0.04 |
| G100K/G104T/S56X | 445 | V3-4_IGLJ1*01 | 3239 | 0.03 |
| G100K/G104T/S56G | 426 | V3-4_IGLJ1*01 | 8433 | 0.05 |
| G100K/G104T/S56X | 445 | V3-4_IGLJ1*01 | 1125 | 0.03 |
| G100K/G104T/S56X | 445 | V3-4_IGLJ1*01 | 1927 | 0.04 |
| G100K/G104T/S56X | 445 | V3-4_IGLJ1*01 | 502 | 0.04 |
| G100K/G104T/S56X | 445 | V3-4_IGLJ1*01 | 1509 | 0.04 |
| G100K/G104T/S56X | 445 | V3-4_IGLJ1*01 | 1951 | 0.03 |
| G100K/G104T/S56X | 445 | V3-4_IGLJ1*01 | 4317 | 0.04 |
| G100K/G104T/S56X | 445 | V3-4_IGLJ1*01 | 2065 | 0.04 |
| G100K/G104T/S56X | 445 | V3-4_IGLJ1*01 | 1486 | 0.02 |

7. Mutagenesis of Amino Acid Residues S84 and D109

The heavy chain KT double mutant was used as a template for mutagenesis of amino acid residues S84 and D109. These amino acid residues were mutated using overlapping PCR with NNK mutagenesis or by alanine scanning. The results are shown in Tables 90-92 below, which depict ECL and ELISA results for binding to DLL4 or various antigens. Mutation of heavy chain residues S84 and D109 caused a reduction in ECL signal for binding to DLL4 as compared to heavy chain mutant Fab KT & V3-4_IGLJ*01.

TABLE 90

Binding of Fab heavy chain VH5-51_IGHD5-18*01 > 3_IGHJ4*01 G100K/G104T (H:KT) & V3-4_IGLJ1*01 S84 and D109A mutants to DLL4

| Heavy Chain VH5-51_IGHD5-18*01_IGHJ4*01 | SEQ ID NO | Light Chain (SEQ ID NO: 108) | ECL Signal | ELISA (Signal-Noise) |
|---|---|---|---|---|
| G100K/G104T S84V | 427 | V3-4_IGLJ1*01 | 37.7 | 0.02 |
| G100K/G104T S84L | 428 | V3-4_IGLJ1*01 | 3.2 | 0.00 |
| G100K/G104T D109A | 429 | V3-4_IGLJ1*01 | 76.8 | 0.00 |
| G100K/G104T | 381 | V3-4_IGLJ1*01 | 85.9 | 0.00 |

TABLE 91

Binding and specificity of Fab heavy chain VH5-51_IGHD5-18*01 > 3_IGHJ4*01 G100K/G104T (H:KT) & V3-4_IGLJ1*01 S84 and D109A mutants to DLL4

| Heavy Chain | ErbB2 | EGF R | HGF R | Notch-1 | CD44 | IGF-1 | P-Cad | EPO R | DLL4 | Blank |
|---|---|---|---|---|---|---|---|---|---|---|
| S84V | 1042 | 805 | 811 | 505 | 577 | 914 | 362 | 484 | 8889 | 236 |
| S84L | 1092 | 864 | 933 | 410 | 545 | 908 | 320 | 458 | 713 | 223 |
| D109A | 1099 | 791 | 846 | 443 | 538 | 967 | 406 | 612 | 21807 | 284 |
| G100K/G104T | 1095 | 852 | 838 | 543 | 579 | 877 | 319 | 554 | 36440 | 424 |

TABLE 92

Binding of Fab heavy chain VH5-51_IGHD5-18*01 > 3_IGHJ4*01 G100K/G104T (H:KT) & V3-4_IGLJ1*01 S84I to DLL4

| Heavy Chain VH5-51_IGHD5-18*01_IGHJ4*01 | SEQ ID NO | Light Chain (SEQ ID NO: 108) | ECL Signal |
|---|---|---|---|
| G100K/G104T | 381 | V3-4_IGLJ1*01 | 9355 |
| G100K/G104T S84I | 409 | V3-4_IGLJ1*01 | 7937 |

C. Light Chain

1. Alanine Scanning of CDR3

Alanine scanning mutagenesis was performed on amino acid residues in the CDR3 of the light chain of parent Fab VH5-51_IGHD5-18*01>3_IGHJ4*01 G100K/G104T (H:KT) & V3-4_IGLJ*01 to identify amino acid residues that do not appear to be involved in DLL4 binding. Alanine scanning mutagenesis was performed by mutation of every residue of CDR3. Purified Fab alanine mutants were tested at a concentration of 0.04 µM for binding to DLL4 using the ECL multispot assay. The results are set forth in Tables 93-94 below. The results show that mutation of amino acid residues L92, Y93, G95, G97, 198, or S99 with alanine resulted in reduced binding to DLL4, and therefore these residues were not further mutagenized. Substitution of V91, M94, or S96 with alanine either improved binding or did not affect binding to DLL4 and thus these residues were identified as residues for further mutagenesis.

TABLE 93

Fab VH5-51_IGHD5-18*01 > 3_IGHJ4*01 G100K/G104T (H:KT) & V3-4_IGLJ1*01 alanine mutant binding data

| Fab | | | | |
|---|---|---|---|---|
| Heavy Chain VH5-51_IGHD5-18*01_IGHJ4*01 | SEQ ID NO | Light Chain V3-4_IGLJ1*01 | SEQ ID NO | ECL Signal/ Noise |
| G100K/G104T | 381 | Parental | 108 | 49.2 |
| G100K/G104T | 381 | V91A | 446 | 48.5 |
| G100K/G104T | 381 | L92A | 447 | 30.3 |
| G100K/G104T | 381 | Y93A | 448 | 21.3 |
| G100K/G104T | 381 | M94A | 449 | 53.1 |
| G100K/G104T | 381 | G95A | 450 | 34.4 |
| G100K/G104T | 381 | G97A | 451 | 24.7 |
| G100K/G104T | 381 | S96A | 452 | 57.9 |
| G100K/G104T | 381 | I98A | 453 | 32.6 |
| G100K/G104T | 381 | S99A | 454 | 41.0 |

TABLE 94

Fab VH5-51_IGHD5-18*01 > 3_IGHJ4*01 G100K/G104T (H:KT) & V3-4_IGLJ1*01 CDR3 alanine mutant binding data

| Light Chain | ErbB2 | EGF R | HGF R | Notch-1 | CD44 | IGF-1 | P-Cad | EPO R | DLL4 | Blank |
|---|---|---|---|---|---|---|---|---|---|---|
| V91A | 1118 | 833 | 1107 | 682 | 632 | 1031 | 484 | 675 | 33377 | 372 |
| L92A | 1374 | 1012 | 1172 | 693 | 695 | 959 | 326 | 582 | 11698 | 328 |
| Y93A | 1404 | 918 | 1130 | 725 | 700 | 1049 | 497 | 602 | 8107 | 388 |
| M94A | 1203 | 1126 | 1151 | 574 | 633 | 1094 | 472 | 614 | 35311 | 388 |
| G95A | 1250 | 995 | 999 | 707 | 657 | 1091 | 345 | 637 | 10445 | 341 |
| G97A | 1292 | 1059 | 1112 | 660 | 642 | 1034 | 474 | 528 | 14892 | 248 |
| S96A | 1275 | 1004 | 1115 | 715 | 678 | 927 | 491 | 684 | 32312 | 321 |
| I98A | 1375 | 1054 | 1227 | 700 | 708 | 1098 | 359 | 584 | 15096 | 1623 |
| S99A | 1323 | 956 | 909 | 674 | 670 | 943 | 500 | 693 | 18191 | 394 |

2. NNK Mutagenesis of CDR3 Amino Acid Residues V91, M94 and S96

Following alanine scanning mutagenesis of CDR3, light chain amino acid residues V91, M94 and S96 were selected for further mutation using overlapping PCR with NNK mutagenesis using Fab VH5-51_IGHD5-18*01>3_IGHJ4*01 G100K/G104T & V3-4_IGLJ*01 as a template. The resulting mutants were assayed using the ECL multispot assay as described in Example 4 or by ELISA as described in Example 6. The results are set forth in Table 95. The ECL results show that V3-4_IGLJ*01 amino acid mutants M94R, S96M and S96E exhibited increased binding to DLL4. No detectable signal was observed by ELISA for any of the mutants tested.

TABLE 95

Fab VH5-51_IGHD5-18*01 > 3_IGHJ4*01 G100K/G104T (H:KT) & V3-4_IGLJ1*01 V91, M94 and S96 NNK mutant binding data

| Fab | | | | |
|---|---|---|---|---|
| Heavy Chain VH5-51_IGHD5-18*01 > 3_IGHJ4*01 (SEQ ID NO: 381) | Light Chain V3-4_IGLJ1*01 | SEQ ID NO | ECL Signal [10 nM Fab] | ELISA Signal [100 nM Fab] |
| G100K/G104T | V91P | 455 | 920 | 0.06 |
| G100K/G104T | V91T | 456 | 32717 | 0.01 |
| G100K/G104T | V91S | 457 | 32077 | 0.01 |
| G100K/G104T | V91L | 458 | 41576 | 0.02 |
| G100K/G104T | V91R | 459 | 13432 | 0.00 |
| G100K/G104T | V91A | 446 | 35576 | 0.01 |
| G100K/G104T | parent | 108 | 42851 | 0.01 |
| G100K/G104T | V91C | 460 | 38330 | 0.02 |
| G100K/G104T | V91E | 461 | 22524 | 0.00 |
| G100K/G104T | V91W | 462 | 12523 | 0.00 |
| G100K/G104T | V91N | 463 | 46674 | 0.00 |
| G100K/G104T | V91I | 464 | 51236 | 0.01 |
| G100K/G104T | V91G | 465 | 45254 | 0.01 |
| G100K/G104T | V91H | 466 | 27123 | 0.01 |
| G100K/G104T | V91A | 446 | 33817 | 0.02 |
| G100K/G104T | M94E | 467 | 32481 | 0.01 |
| G100K/G104T | M94S | 468 | 49579 | 0.02 |
| G100K/G104T | M94G | 469 | 20338 | 0.01 |
| G100K/G104T | M94L | 470 | 46770 | 0.02 |
| G100K/G104T | M94P | 471 | 39930 | 0.01 |
| G100K/G104T | M94V | 472 | 47326 | 0.02 |
| G100K/G104T | M94D | 473 | 52677 | 0.01 |
| G100K/G104T | M94R | 474 | 77777 | 0.01 |
| G100K/G104T | M94N | 475 | 51284 | 0.01 |
| G100K/G104T | M94T | 476 | 43017 | 0.02 |
| G100K/G104T | M94F | 477 | 26330 | 0.01 |
| G100K/G104T | M94A | 449 | 33484 | 0.01 |
| G100K/G104T | M94A | 449 | 37962 | 0.00 |
| G100K/G104T | S96W | 478 | 52299 | 0.02 |
| G100K/G104T | S96G | 479 | 40377 | 0.01 |
| G100K/G104T | S96P | 480 | 53997 | 0.03 |
| G100K/G104T | S96A/E | 579 | 43247 | 0.02 |
| G100K/G104T | S96R | 481 | 54259 | 0.02 |
| G100K/G104T | S96L | 482 | 39950 | 0.02 |
| G100K/G104T | S96M | 483 | 61737 | 0.02 |

TABLE 95-continued

Fab VH5-51_IGHD5-18*01 > 3_IGHJ4*01 G100K/G104T (H:KT) & V3-4_IGLJ*01 V91, M94 and S96 NNK mutant binding data

| Fab | | | | |
|---|---|---|---|---|
| Heavy Chain VH5-51_IGHD5-18*01 > 3_IGHJ4*01 (SEQ ID NO: 381) | Light Chain V3-4_IGLJ1*01 | SEQ ID NO | ECL Signal [10 nM Fab] | ELISA Signal [100 nM Fab] |
| G100K/G104T | S96E | 484 | 57030 | 0.02 |
| G100K/G104T | parent | 108 | 36614 | 0.01 |
| G100K/G104T | S96V | 485 | 42293 | 0.01 |
| G100K/G104T | S96A | 452 | 1128 | 0.00 |

3. Combination Mutants of M94 and S96

V3-4_IGLJ1*01 light chain mutants M94R and S96M, identified as contributing to increased binding to DLL4, were combined to generate a double mutant. The double mutant is designated as V3-4_IGLJ1*01 M94R/S96M (L:RM). The binding affinity of the L:RM double mutant, as paired with various heavy chain mutants including H:KT, H:KT S28R, H:KT LRV, H:KT TRV, and H:KT ARV, was determined by ECL assay as described in Example 4. The results are set forth in Table 96 below. Fab H:KT TRV & L:RM exhibited the greatest ECL signal for binding to DLL4 compared to other Fab antibodies tested.

The mutant Fabs above were further analyzed for binding to DLL4 by ELISA as described in Example 6 using 3-fold serial dilutions of Fab, starting at a concentration of 20 nM. The results are set forth in Table 97 below. Similar to the ECL results, Fab H:KT TRV & L:RM exhibited the greatest ELISA signal for binding to DLL4 compared to other mutant Fab antibodies tested.

TABLE 96

Fab VH5-51_IGHD5-18*01 > 3_IGHJ4*01 G100K/G104T (KT) & V3-4_IGLJ1*01 CDR3 combination mutants

| Fab | | | | |
|---|---|---|---|---|
| Heavy Chain VH5-51_IGHD5-18*01_IGHJ4*01 | SEQ ID NO | Light Chain V3-4_IGLJ1*01 | SEQ ID NO | ECL Signal |
| G100K/G104T | 381 | M94R/S96M | 486 | 564 |
| G100K/G104T S28R | 411 | M94R/S96M | 486 | 530 |
| G100K/G104T G24L/S28R/G35V | 417 | M94R/S96M | 486 | 889 |
| G100K/G104T G24T/S28R/G35V | 430 | M94R/S96M | 486 | 17277 |
| G100K/G104T G24A/S28R/G35V | 431 | M94R/S96M | 486 | 1202 |

TABLE 97

Fab VH5-51_IGHD5-18*01 > 3_IGHJ4*01 & V3-4_IGLJ*01 mutant binding to DLL4 by ELISA

| Heavy Chain VH5-51_IGHD5-18*01 > 3_IGHJ4*01 | Light Chain V3-4_IGLJ*01 | 20 | 6.67 | 2.22 | 0.74 |
|---|---|---|---|---|---|
| G100K/G104T | parent | 0.018 | 0.042 | 0.014 | 0.019 |
| G100K/G104T S28R | parent | 0.009 | 0.003 | 0.000 | 0.000 |
| G100K/G104T G24L/S28R/G35V | parent | 0.027 | 0.005 | 0.000 | 0.006 |
| G100K/G104T G24T/S28R/G35V | parent | 0.054 | 0.023 | 0.000 | 0.002 |

TABLE 97-continued

Fab VH5-51_IGHD5-18*01 > 3_IGHJ4*01 & V3-4_IGLJ*01 mutant binding to DLL4 by ELISA

| Heavy Chain VH5-51_IGHD5-18*01 > 3_IGHJ4*01 | Light Chain V3-4_IGLJ*01 | 20 | 6.67 | 2.22 | 0.74 |
|---|---|---|---|---|---|
| G100K/G104T G24A/S28R/G35V | parent | 0.054 | 0.025 | 0.002 | 0.008 |
| G100K/G104T | M94R/S96M | 0.087 | 0.023 | 0.007 | 0.000 |
| G100K/G104T S28R | M94R/S96M | 0.011 | 0.001 | 0.003 | 0.000 |
| G100K/G104T G24L/S28R/G35V | M94R/S96M | 0.003 | 0.000 | 0.000 | 0.000 |
| G100K/G104T G24T/S28R/G35V | M94R/S96M | 0.122 | 0.062 | 0.028 | 0.006 |
| G100K/G104T G24A/S28R/G35V | M94R/S96M | 0.006 | 0.034 | 0.000 | 0.000 |

4. Alanine Scanning of CDR1 of Light Chain

Heavy chain KT double mutant (Fab VH5-51_IGHD5-18*01>3_IGHJ4*01 G100K/G104T & V3-4_IGLJ*01) was used as a template for alanine scanning mutagenesis of CDR1 (amino acids 23-33) of the light chain to determine residues important for antibody binding to DLL4.

Purified Fab alanine mutants were tested for at a concentration of 100 nM for binding to DLL4 using the ECL multispot binding assay as described in Example 4A. The results are set forth in Table 98 below. Mutation of amino acid residues Y33, Y34 and P35 with alanine resulted in reduced binding to DLL4 as evidenced by the reduced ECL signal. Mutation of amino acid residues G23, L24, S25, S26, G27, S28, V29, S30, T31, and S32 with alanine either improved binding or did not affect binding to DLL4 as evidenced by an increased ECL signal or no change in ECL signal compared to the parent KT double mutant having no mutations in the light chain.

TABLE 98

Binding affinity of Fab VH5-51_IGHD5-18*01 > 3_IGHJ4*01 G100K/G104T (H:KT) & V3-4_IGLJ*01 light chain CDR1 and CDR2 alanine mutants

| Heavy Chain VH5-51_IGHD5-18*03_IGHJ4*01 (SEQ ID NO: 381) | Light Chain V3-4_IGLJ1*01 | SEQ ID NO | ECL Signal |
|---|---|---|---|
| G100K/G104T | wildtype | 108 | 9355 |
| G100K/G104T | L24A | 487 | 9631 |
| G100K/G104T | S26A | 488 | 11673 |
| G100K/G104T | G27A | 489 | 10680 |
| G100K/G104T | S28A | 490 | 11488 |
| G100K/G104T | V29A | 491 | 9323 |
| G100K/G104T | S30A | 492 | 10342 |
| G100K/G104T | T31A | 493 | 13507 |
| G100K/G104T | S32A | 494 | 10377 |
| G100K/G104T | Y33A | 495 | 7705 |
| G100K/G104T | Y34A | 496 | 2198 |
| G100K/G104T | P35A | 497 | 8255 |
| G100K/G104T | S36A | 498 | 9690 |
| G100K/G104T | G23A | 499 | 13487 |
| G100K/G104T | S25A | 500 | 10150 |

5. NNK Mutagenesis of Amino Acid Residue G23

Following alanine scanning mutagenesis of CDR1, the light chain amino acid residue G23 was selected for further NNK mutagenesis using the Fab H:KT & L:wt double mutant as a template. The ECL and ELISA signals are set forth in Table 99 below Amino acid mutations designated with X (for any amino acid) did not show appreciable binding and therefore were not sequenced to identify the exact mutation.

TABLE 99

Fab VH5-51_IGHD5-18*01 > 3_IGHJ4*01 G100K/G104T
(H:KT) & V3-4_IGLJ*01 CDR1 G23 NNK mutant binding data

| Fab | | | | |
|---|---|---|---|---|
| Heavy Chain VH5-51_IGHD5-18*01 > 3_IGHJ4*01 G100K/G104T (SEQ ID NO: 381) | Light Chain | SEQ ID NO | ECL Signal | ELISA Signal |
| G100K/G104T | G23R | 501 | 68243 | 0.11 |
| G100K/G104T | G23X | 580 | 61919 | 0.10 |
| G100K/G104T | G23X | 580 | 327 | 0.09 |
| G100K/G104T | G23X | 580 | 68201 | 0.12 |
| G100K/G104T | G23X | 580 | 384 | 0.09 |
| G100K/G104T | G23X | 580 | 67230 | 0.11 |
| G100K/G104T | G23X | 580 | 70515 | 0.09 |
| G100K/G104T | G23X | 580 | 56769 | 0.10 |
| G100K/G104T | G23X | 580 | 322 | 0.09 |
| G100K/G104T | G23L | 502 | 67320 | 0.10 |
| G100K/G104T | G23L | 502 | 67618 | 0.10 |
| G100K/G104T | G23X | 580 | 66603 | 0.12 |
| G100K/G104T | G23X | 580 | 62101 | 0.10 |
| G100K/G104T | G23X | 580 | 50904 | 0.10 |
| G100K/G104T | G23X | 580 | 61718 | 0.11 |
| G100K/G104T | G23X | 580 | 67917 | 0.11 |
| G100K/G104T | G23X | 580 | 414 | 0.09 |
| G100K/G104T | G23X | 580 | 52864 | 0.10 |
| G100K/G104T | G23X | 580 | 53493 | 0.10 |

6. Alanine Scanning of CDR2

Heavy chain KT double mutant (Fab VH5-51_IGHD5-18*01>3_IGHJ4*01 G100K/G104T & V3-4_IGLJ*01) was used as a template for alanine scanning mutagenesis of CDR2 (amino acids 52-58) to determine residues important for antibody binding to DLL4.

Purified Fab alanine mutants were tested for binding to DLL4 using the ECL multispot binding assay as described in Example 4. The results are set forth in Table 100 below. Mutation of amino acid residues S52, T53, N54, T55, R56, S57 and S58 with alanine either improved binding or did not affect binding to DLL4 as evidenced by an increased ECL signal or no change in ECL signal compared to the parent KT double mutant having no mutations in the light chain.

TABLE 100

Binding affinity of Fab VH5-51_IGHD5-18*01 > 3_IGHJ4*01
G100K/G104T (H:KT) & V3-4_IGLJ*01 light chain
CDR2 alanine mutants

| Heavy Chain VH5-51_IGHD5-18*03_IGHJ4*01 (SEQ ID NO: 381) | Light Chain V3-4_IGLJ1*01 | SEQ ID NO | ECL Signal |
|---|---|---|---|
| G100K/G104T | wildtype | 108 | 9355 |
| G100K/G104T | S52A | 503 | 15240 |
| G100K/G104T | T53A | 504 | 13197 |
| G100K/G104T | N54A | 505 | 12936 |
| G100K/G104T | T55A | 506 | 12717 |
| G100K/G104T | R56A | 507 | 16833 |
| G100K/G104T | S57A | 508 | 12612 |
| G100K/G104T | S58A | 509 | 12557 |
| G100K/G104T | R56A | 507 | 13609 |

7. NNK Mutagenesis of Amino Acid Residues S52 and R56

Following alanine scanning mutagenesis of CDR2, light chain amino acid residues S52 and R56 were selected for further NNK mutagenesis using the heavy chain KT double mutant as a template. The ECL and ELISA signals are set forth in Table 101 below. Amino acid mutations designated with X (for any amino acid) did not show appreciable binding and therefore were not sequenced to identify the exact mutation. Light chain mutants S52G, R56Y/S, R56A and R56G exhibited increased binding to DLL4 as assessed by both ECL and ELISA.

Various Fabs, containing various combinations of mutations of the heavy chain and light chain, were further analyzed for binding to DLL4 by ELISA using 2-fold serial dilutions of Fab, starting at a concentration of 100 nM. The results are set forth in Table 102 below. Fab H:KT S28R & L:wt exhibited the greatest binding to DLL4 as evidenced by the ELISA signal compared to other Fab mutants tested.

TABLE 101

Fab VH5-51_IGHD5-18*01 > 3_IGHJ4*01
G100K/G104T (KT) & V3-4_IGLJ*01 CDR1 S52 and
R56 NNK mutant binding data

| Fab | | | | |
|---|---|---|---|---|
| Heavy Chain VH5-51_IGHD5-18*01 > 3_IGHJ4*01 G100K/G104T (SEQ ID NO: 381) | Light Chain V3-4_IGLJ*01 | SEQ ID NO | ECL Signal | ELISA Signal |
| G100K/G104T | S52X | 581 | 64794 | 0.10 |
| G100K/G104T | S52X | 581 | 58732 | 0.10 |
| G100K/G104T | S52C | 511 | 64255 | 0.10 |
| G100K/G104T | S52X | 581 | 84622 | 0.13 |
| G100K/G104T | S52X | 581 | 78239 | 0.14 |
| G100K/G104T | S52X | 581 | 62099 | 0.11 |
| G100K/G104T | S52X | 581 | 76278 | 0.14 |
| G100K/G104T | S52X | 581 | 84797 | 0.15 |
| G100K/G104T | S52G | 510 | 85929 | 0.21 |
| G100K/G104T | S52G | 510 | 86660 | 0.18 |
| G100K/G104T | S52X | 581 | 81950 | 0.13 |
| G100K/G104T | S52X | 581 | 79552 | 0.11 |
| G100K/G104T | S52X | 581 | 84470 | 0.14 |
| G100K/G104T | S52X | 581 | 356 | 0.09 |
| G100K/G104T | S52R | 512 | 85879 | 0.15 |
| G100K/G104T | S52X | 581 | 84017 | 0.16 |
| G100K/G104T | S52X | 581 | 67861 | 0.14 |
| G100K/G104T | S52X | 581 | 100221 | 0.17 |
| G100K/G104T | S52X | 581 | 61304 | 0.12 |
| G100K/G104T | R56X | 582 | 69586 | 0.13 |
| G100K/G104T | R56X | 582 | 75844 | 0.15 |
| G100K/G104T | R56X | 582 | 93607 | 0.13 |
| G100K/G104T | R56X | 582 | 58626 | 0.11 |
| G100K/G104T | R56X | 582 | 82996 | 0.14 |
| G100K/G104T | R56X | 582 | 71685 | 0.12 |
| G100K/G104T | R56X | 582 | 73639 | 0.11 |
| G100K/G104T | R56I | 513 | 94265 | 0.13 |
| G100K/G104T | R56Y/S | 583 | 95103 | 0.28 |
| G100K/G104T | R56X | 582 | 367 | 0.09 |
| G100K/G104T | R56X | 582 | 82747 | 0.26 |
| G100K/G104T | R56X | 582 | 80011 | 0.16 |
| G100K/G104T | R56D | 515 | 87363 | 0.19 |
| G100K/G104T | R56G | 516 | 93708 | 0.19 |
| G100K/G104T | R56A | 507 | 83853 | 0.27 |
| G100K/G104T | R56X | 582 | 91910 | 0.15 |
| G100K/G104T | R56X | 582 | 58466 | 0.11 |
| G100K/G104T | R56X | 582 | 45685 | 0.11 |
| G100K/G104T | R56X | 582 | 55229 | 0.12 |

TABLE 102

Fab VH5-51_IGHD5-18*01 > 3_IGHJ4*01 & V3-4_IGLJ*01 mutant binding to DLL4 by ELISA

| Fab [nM] | H L | KT G24L parent | KT S28R parent | KT G35V parent | KT T58A parent | KT T58D parent | KT S52G | KT R56Y | KT R56A |
|---|---|---|---|---|---|---|---|---|---|
| 100 | | 0.298 | 0.529 | 0.271 | 0.253 | 0.219 | 0.209 | 0.231 | 0.251 |
| 50 | | 0.245 | 0.456 | 0.232 | 0.209 | 0.230 | 0.194 | 0.211 | 0.239 |
| 25 | | 0.221 | 0.365 | 0.232 | 0.220 | 0.218 | 0.227 | 0.205 | 0.227 |
| 12.5 | | 0.233 | 0.309 | 0.244 | 0.230 | 0.223 | 0.215 | 0.184 | 0.212 |
| 6.25 | | 0.278 | 0.303 | 0.245 | 0.249 | 0.224 | 0.207 | 0.182 | 0.200 |
| 3.125 | | 0.257 | 0.246 | 0.251 | 0.244 | 0.252 | 0.216 | 0.180 | 0.213 |

H—heavy chain
L—Light Chain

8. Mutagenesis of Framework 3 Amino Acid Residue T78

The KT heavy chain double mutant (Fab VH5-51_IGHD5-18*01>3_IGHJ4*01 G100K/G104T (H:KT) & V3-4_IGLJ*01) was used as a template for further mutagenesis of amino acid residue T78 in the framework 3 region of the light chain. This residue was mutated using overlapping PCR with NNK mutagenesis. Table 103 sets forth the ECL signal for binding to DLL4. Mutation of amino acid residue T78 either improved binding or did not affect binding to DLL4 as evidenced by an increased ECL signal or no change in ECL signal compared to the parent KT double mutant having no mutations in the light chain. Two additional light chain double mutants G23A/N175K (in the constant region) and S52A/A116T (in the framework 4 region) also were generated and they exhibited improved binding for DLL4 compared to the KT double mutant template antibody as evidenced by an increased ECL signal.

TABLE 103

Binding affinity of Fab VH5-51_IGHD5-18*01 > 3_IGHJ4*01 G100K/G104T (H:KT) & V3-4_IGLJ*01 light chain mutants

| Heavy Chain VH5-51_IGHD5-18*03_IGHJ4*01 (SEQ ID NO: 381) | Light Chain V3-4_IGLJ1*01 | SEQ ID NO | ECL Signal |
|---|---|---|---|
| G100K/G104T | wildtype | 108 | 9355 |
| G100K/G104T | T78S | 518 | 7554 |
| G100K/G104T | T78E | 519 | 10559 |
| G100K/G104T | T78Y/M | 584 | 12364 |

TABLE 103-continued

Binding affinity of Fab VH5-51_IGHD5-18*01 > 3_IGHJ4*01 G100K/G104T (H:KT) & V3-4_IGLJ*01 light chain mutants

| Heavy Chain VH5-51_IGHD5-18*03_IGHJ4*01 (SEQ ID NO: 381) | Light Chain V3-4_IGLJ1*01 | SEQ ID NO | ECL Signal |
|---|---|---|---|
| G100K/G104T | T78L | 522 | 9554 |
| G100K/G104T | T78K | 523 | 9620 |
| G100K/G104T | T78V | 524 | 9833 |
| G100K/G104T | G23A, N175K | 525 | 17828 |
| G100K/G104T | S25A, A116T | 526 | 12178 |

9. Paired Mutants of Heavy Chain KT TRV

The SPR data (see Example 5 and Table 108) for Fabs H:KT TRV & V3-4_IGLJ1*01 and H:KT TRV & L:RM indicated that these Fabs have a short off-rate. Thus, in order to increase binding affinity of these antibodies, heavy chain H:KT TRV was paired with various V3-4_IGLJ1*01 light chain mutants and the binding affinity towards DLL4 was assayed by ELISA since the ELISA assay selects for long off-rates whereas the ECL assay detects equilibrium binding.

Purified Fab mutants were tested for binding to DLL4 using ELISA performed as described in Example 6 at a concentration of 100 nM Fab. The results for the ELISA assay are set forth in Table 104. Fabs containing light chain mutants V91A, T31A, S52A, T53A, S57A, V91L, S96G and S96P exhibited increased binding to DLL4 as compared to a Fab with parental light chain V3-4_IGLJ*01 as evidenced by a greater ELISA signal-blank.

TABLE 104

Fab VH5-51_IGHD5-18*01 > 3_IGHJ4*01 G100K/G104T G24T/S28R/G35V (H:KT TRV) & V3-4_IGLJ1*01 light chain mutant binding data

| Fab | | | | ELISA Signal- |
|---|---|---|---|---|
| Heavy Chain VH5-51_IGHD5-18*01_IGHJ4*01 | SEQ ID NO | Light Chain V3-4_IGLJ1*01 | SEQ ID NO | blank (100 nM Fab) |
| G100K/G104T G24T/S28R/G35V | 430 | V91A | 446 | 0.606 |
| G100K/G104T G24T/S28R/G35V | 430 | L92A | 447 | 0.186 |
| G100K/G104T G24T/S28R/G35V | 430 | Y93A | 448 | 0.185 |
| G100K/G104T G24T/S28R/G35V | 430 | M94A | 449 | 0.277 |
| G100K/G104T G24T/S28R/G35V | 430 | G95A | 450 | 0.216 |
| G100K/G104T G24T/S28R/G35V | 430 | S96A | 452 | 0.436 |
| G100K/G104T G24T/S28R/G35V | 430 | G97A | 451 | 0.129 |
| G100K/G104T G24T/S28R/G35V | 430 | I98A | 453 | 0.162 |
| G100K/G104T G24T/S28R/G35V | 430 | S99A | 454 | 0.300 |
| G100K/G104T G24T/S28R/G35V | 430 | T78S | 518 | 0.093 |
| G100K/G104T G24T/S28R/G35V | 430 | T78E | 519 | 0.217 |
| G100K/G104T G24T/S28R/G35V | 430 | T78Y/M | 584 | 0.459 |
| G100K/G104T G24T/S28R/G35V | 430 | T78L | 522 | 0.347 |

TABLE 104-continued

Fab VH5-51_IGHD5-18*01 > 3_IGHJ4*01 G100K/G104T G24T/S28R/G35V
(H:KT TRV) & V3-4_IGLJ1*01 light chain mutant binding data

| Fab | | | | ELISA Signal- |
|---|---|---|---|---|
| Heavy Chain<br>VH5-51_IGHD5-18*01_IGHJ4*01 | SEQ ID<br>NO | Light Chain<br>V3-4_IGLJ1*01 | SEQ ID<br>NO | blank<br>(100 nM Fab) |
| G100K/G104T G24T/S28R/G35V | 430 | T78K | 523 | 0.480 |
| G100K/G104T G24T/S28R/G35V | 430 | T78V | 524 | 0.340 |
| G100K/G104T G24T/S28R/G35V | 430 | G23A | 499 | 0.405 |
| G100K/G104T G24T/S28R/G35V | 430 | L24A | 487 | 0.244 |
| G100K/G104T G24T/S28R/G35V | 430 | S25A | 500 | 0.483 |
| G100K/G104T G24T/S28R/G35V | 430 | S26A | 488 | 0.395 |
| G100K/G104T G24T/S28R/G35V | 430 | G27A | 489 | 0.398 |
| G100K/G104T G24T/S28R/G35V | 430 | S28A | 490 | 0.478 |
| G100K/G104T G24T/S28R/G35V | 430 | V29A | 491 | 0.394 |
| G100K/G104T G24T/S28R/G35V | 430 | S30A | 492 | 0.344 |
| G100K/G104T G24T/S28R/G35V | 430 | T31A | 493 | 0.552 |
| G100K/G104T G24T/S28R/G35V | 430 | S32A | 494 | 0.502 |
| G100K/G104T G24T/S28R/G35V | 430 | Y33A | 495 | 0.301 |
| G100K/G104T G24T/S28R/G35V | 430 | Y34A | 496 | 0.085 |
| G100K/G104T G24T/S28R/G35V | 430 | P35A | 497 | 0.236 |
| G100K/G104T G24T/S28R/G35V | 430 | S36A | 498 | 0.380 |
| G100K/G104T G24T/S28R/G35V | 430 | S52A | 503 | 0.574 |
| G100K/G104T G24T/S28R/G35V | 430 | T53A | 504 | 0.532 |
| G100K/G104T G24T/S28R/G35V | 430 | N54A | 505 | 0.318 |
| G100K/G104T G24T/S28R/G35V | 430 | T55A | 506 | 0.382 |
| G100K/G104T G24T/S28R/G35V | 430 | R56A | 507 | 0.442 |
| G100K/G104T G24T/S28R/G35V | 430 | S57A | 508 | 0.598 |
| G100K/G104T G24T/S28R/G35V | 430 | S58A | 509 | 0.451 |
| G100K/G104T G24T/S28R/G35V | 430 | V91L | 458 | 0.734 |
| G100K/G104T G24T/S28R/G35V | 430 | V91P | 455 | 0.078 |
| G100K/G104T G24T/S28R/G35V | 430 | V91T | 456 | 0.197 |
| G100K/G104T G24T/S28R/G35V | 430 | V91S | 457 | 0.264 |
| G100K/G104T G24T/S28R/G35V | 430 | V91R | 459 | 0.025 |
| G100K/G104T G24T/S28R/G35V | 430 | V91A | 446 | 0.529 |
| G100K/G104T G24T/S28R/G35V | 430 | Parent | 108 | 0.393 |
| G100K/G104T G24T/S28R/G35V | 430 | V91C | 460 | 0.625 |
| G100K/G104T G24T/S28R/G35V | 430 | V91E | 461 | 0.152 |
| G100K/G104T G24T/S28R/G35V | 430 | V91W | 462 | 0.080 |
| G100K/G104T G24T/S28R/G35V | 430 | V91N | 463 | 0.203 |
| G100K/G104T G24T/S28R/G35V | 430 | V91I | 464 | 0.336 |
| G100K/G104T G24T/S28R/G35V | 430 | V91G | 465 | 0.248 |
| G100K/G104T G24T/S28R/G35V | 430 | V91H | 466 | 0.127 |
| G100K/G104T G24T/S28R/G35V | 430 | M94T | 476 | 0.395 |
| G100K/G104T G24T/S28R/G35V | 430 | M94E | 467 | 0.171 |
| G100K/G104T G24T/S28R/G35V | 430 | M94S | 468 | 0.195 |
| G100K/G104T G24T/S28R/G35V | 430 | M94G | 469 | 0.199 |
| G100K/G104T G24T/S28R/G35V | 430 | M94L | 470 | 0.388 |
| G100K/G104T G24T/S28R/G35V | 430 | M94P | 471 | 0.256 |
| G100K/G104T G24T/S28R/G35V | 430 | M94V | 472 | 0.315 |
| G100K/G104T G24T/S28R/G35V | 430 | M94D | 473 | 0.070 |
| G100K/G104T G24T/S28R/G35V | 430 | M94R | 474 | 0.197 |
| G100K/G104T G24T/S28R/G35V | 430 | M94N | 475 | 0.205 |
| G100K/G104T G24T/S28R/G35V | 430 | M94F | 477 | 0.317 |
| G100K/G104T G24T/S28R/G35V | 430 | M94A | 449 | 0.216 |
| G100K/G104T G24T/S28R/G35V | 430 | S96W | 478 | 0.261 |
| G100K/G104T G24T/S28R/G35V | 430 | S96G | 479 | 0.562 |
| G100K/G104T G24T/S28R/G35V | 430 | S96P | 480 | 0.813 |
| G100K/G104T G24T/S28R/G35V | 430 | S96A/E | 579 | 0.538 |
| G100K/G104T G24T/S28R/G35V | 430 | S96R | 481 | 0.499 |
| G100K/G104T G24T/S28R/G35V | 430 | S96L | 482 | 0.355 |
| G100K/G104T G24T/S28R/G35V | 430 | S96M | 483 | 0.358 |
| G100K/G104T G24T/S28R/G35V | 430 | S96E | 484 | 0.439 |
| G100K/G104T G24T/S28R/G35V | 430 | Parent | 108 | 0.437 |
| G100K/G104T G24T/S28R/G35V | 430 | S96V | 485 | 0.452 |
| G100K/G104T G24T/S28R/G35V | 430 | Parent | 108 | 0.455 |
| G100K/G104T G24T/S28R/G35V | 430 | Parent | 108 | 0.430 |

10. Cassette Mutagenesis Using Type II Restriction Enzyme Ligatioin of Amino Acid Residues S52, T53 and S57

Following analysis of paired Fab mutants of heavy chain H:KT TRV, light chain double mutant V3-4_IGLJ1*01 V91L/S96P (L:LP) was generated. Three additional light chain amino acid residues (S52, T53 and S57) that exhibited increased binding to DLL4 by ELISA (see Table 103 above) were selected for further mutagenesis using type II restriction enzyme ligation using Fab H: KT TRV & L:LP as a template. The ELISA signals are set forth in Table 105 below. Light chain mutants L:LP S52G, L:LP S52M, L:LP S52N and L:LP S52H exhibited increased binding to DLL4 as assessed by ELISA.

Four Fabs, containing various combinations of mutations of the heavy chain and light chain, were further analyzed for binding to DLL4 by ELISA using 3-fold serial dilutions of Fab, starting at a concentration of 100 nM. The results are set forth in Table 106 below. Fab H:KT TRV & L:LP S52G exhibited the greatest binding to DLL4 as evidenced by the ELISA signal compared to other Fab mutants tested.

TABLE 105

Fab VH5-51_IGHD5-18*01 > 3_IGHJ4*01 G100K/G104T G24T/S28R/G35V (H:KT TRV) & V3-4_IGLJ1*01 V91L/S96P (L:LP) light chain mutant binding data

| Heavy Chain VH5-51_IGHD5-18*01_IGHJ4*01 | SEQ ID NO | Light Chain V3-4_IGLJ1*01 | SEQ ID NO | ELISA Signal- blank (100 nM Fab) |
|---|---|---|---|---|
| G100K/G104T G24T/S28R/G35V | 430 | V91L/S96P S52F | 527 | 0.33 |
| G100K/G104T G24T/S28R/G35V | 430 | V91L/S96P S52L | 528 | 0.40 |
| G100K/G104T G24T/S28R/G35V | 430 | V91L/S96P S52I | 529 | 0.42 |
| G100K/G104T G24T/S28R/G35V | 430 | V91L/S96P S52M | 530 | 0.46 |
| G100K/G104T G24T/S28R/G35V | 430 | V91L/S96P S52V | 531 | 0.44 |
| G100K/G104T G24T/S28R/G35V | 430 | V91L/S96P S52P | 532 | 0.32 |
| G100K/G104T G24T/S28R/G35V | 430 | V91L/S96P S52T | 533 | 0.34 |
| G100K/G104T G24T/S28R/G35V | 430 | V91L/S96P S52Y | 534 | 0.41 |
| G100K/G104T G24T/S28R/G35V | 430 | V91L/S96P S52H | 535 | 0.44 |
| G100K/G104T G24T/S28R/G35V | 430 | V91L/S96P S52Q | 536 | 0.39 |
| G100K/G104T G24T/S28R/G35V | 430 | V91L/S96P S52N | 537 | 0.45 |
| G100K/G104T G24T/S28R/G35V | 430 | V91L/S96P S52K | 538 | 0.32 |
| G100K/G104T G24T/S28R/G35V | 430 | V91L/S96P S52D | 539 | 0.39 |
| G100K/G104T G24T/S28R/G35V | 430 | V91L/S96P S52E | 540 | 0.38 |
| G100K/G104T G24T/S28R/G35V | 430 | V91L/S96P S52W | 541 | 0.29 |
| G100K/G104T G24T/S28R/G35V | 430 | V91L/S96P S52G | 543 | 0.53 |
| G100K/G104T G24T/S28R/G35V | 430 | V91L/S96P | 544 | 0.39 |
| G100K/G104T G24T/S28R/G35V | 430 | V91L/S96P T53F | 545 | 0.15 |
| G100K/G104T G24T/S28R/G35V | 430 | V91L/S96P T53L | 546 | 0.18 |
| G100K/G104T G24T/S28R/G35V | 430 | V91L/S96P T53I | 547 | 0.30 |
| G100K/G104T G24T/S28R/G35V | 430 | V91L/S96P T53M | 548 | 0.01 |
| G100K/G104T G24T/S28R/G35V | 430 | V91L/S96P T53V | 549 | 0.29 |
| G100K/G104T G24T/S28R/G35V | 430 | V91L/S96P T53S | 550 | 0.18 |
| G100K/G104T G24T/S28R/G35V | 430 | V91L/S96P T53P | 551 | 0.39 |
| G100K/G104T G24T/S28R/G35V | 430 | V91L/S96P T53Y | 552 | 0.22 |
| G100K/G104T G24T/S28R/G35V | 430 | V91L/S96P T53H | 553 | 0.14 |
| G100K/G104T G24T/S28R/G35V | 430 | V91L/S96P T53Q | 554 | 0.11 |
| G100K/G104T G24T/S28R/G35V | 430 | V91L/S96P T53N | 555 | 0.15 |
| G100K/G104T G24T/S28R/G35V | 430 | V91L/S96P T53K | 556 | 0.12 |
| G100K/G104T G24T/S28R/G35V | 430 | V91L/S96P T53D | 557 | 0.16 |
| G100K/G104T G24T/S28R/G35V | 430 | V91L/S96P T53E | 558 | 0.09 |
| G100K/G104T G24T/S28R/G35V | 430 | V91L/S96P T53W | 559 | 0.06 |
| G100K/G104T G24T/S28R/G35V | 430 | V91L/S96P T53R | 560 | 0.05 |
| G100K/G104T G24T/S28R/G35V | 430 | V91L/S96P T53G | 561 | 0.08 |
| G100K/G104T G24T/S28R/G35V | 430 | V91L/S96P | 544 | 0.30 |
| G100K/G104T G24T/S28R/G35V | 430 | V91L/S96P S57F | 562 | 0.10 |
| G100K/G104T G24T/S28R/G35V | 430 | V91L/S96P S57L | 563 | 0.30 |
| G100K/G104T G24T/S28R/G35V | 430 | V91L/S96P S57I | 564 | 0.24 |
| G100K/G104T G24T/S28R/G35V | 430 | V91L/S96P S57M | 565 | 0.30 |
| G100K/G104T G24T/S28R/G35V | 430 | V91L/S96P S57V | 566 | 0.34 |
| G100K/G104T G24T/S28R/G35V | 430 | V91L/S96P S57P | 567 | 0.36 |
| G100K/G104T G24T/S28R/G35V | 430 | V91L/S96P S57T | 568 | 0.30 |
| G100K/G104T G24T/S28R/G35V | 430 | V91L/S96P S57Y | 569 | 0.28 |
| G100K/G104T G24T/S28R/G35V | 430 | V91L/S96P S57H | 570 | 0.21 |
| G100K/G104T G24T/S28R/G35V | 430 | V91L/S96P S57Q | 571 | 0.21 |
| G100K/G104T G24T/S28R/G35V | 430 | V91L/S96P S57N | 572 | 0.24 |
| G100K/G104T G24T/S28R/G35V | 430 | V91L/S96P S57K | 573 | 0.17 |
| G100K/G104T G24T/S28R/G35V | 430 | V91L/S96P S57D | 574 | 0.17 |
| G100K/G104T G24T/S28R/G35V | 430 | V91L/S96P S57E | 575 | 0.20 |
| G100K/G104T G24T/S28R/G35V | 430 | V91L/S96P S57W | 576 | 0.12 |
| G100K/G104T G24T/S28R/G35V | 430 | V91L/S96P S57R | 577 | 0.18 |
| G100K/G104T G24T/S28R/G35V | 430 | V91L/S96P S57G | 578 | 0.23 |
| G100K/G104T G24T/S28R/G35V | 430 | V91L/S96P | 544 | 0.29 |

TABLE 106

Binding affinity of Fab VH5-51_IGHD5-18*01 > 3_IGHJ4*01 G100K/G104T G24T/S28R/G35V (H:KT TRV) & V3-4_IGLJ1*01 light chain mutants

| Light Chain Fab [μM] | Wildtype (SEQ ID NO: 108) Signal | V91L/S96P (SEQ ID NO: 544) Signal | V91L/S96P S52M (SEQ ID NO: 530) Signal | V91L/S96P S52G (SEQ ID NO: 543) Signal |
|---|---|---|---|---|
| 100 | 0.16 | 0.34 | 0.24 | 0.69 |
| 33.33 | 0.08 | 0.19 | 0.12 | 0.35 |
| 11.11 | 0.04 | 0.07 | 0.06 | 0.17 |
| 3.70 | 0.03 | 0.03 | 0.03 | 0.06 |
| 1.23 | 0.01 | 0.03 | 0.03 | 0.03 |
| 0.41 | 0.01 | 0.02 | 0.03 | 0.01 |
| 0.14 | 0.00 | 0.03 | 0.02 | 0.02 |
| 0.05 | 0.01 | 0.02 | 0.02 | 0.02 |

11. Paired Fab Mutants

Twenty four mutant Fabs, containing various combinations of mutations of the heavy chain and light chain, were further analyzed for binding to DLL4 by ELISA using 2-fold serial dilutions of Fab, starting at a concentration of 100 nM. The results are set forth in Table 107 below. Fabs H:KT TRV & L:LP S52K and H:KT TRV & L:LP S52G exhibited the greatest binding affinity to DLL4 as evidenced by the ELISA signal compared to other Fab mutants tested. Fabs H:KT TRV & L:LP S52H and H:KT TRV & L:LP S52N had slightly reduced binding affinity to DLL4 as compared to Fabs H:KT TRV & L:LP S52K and H:KT TRV & L:LP S52G.

TABLE 107

Fab VH5-51_IGHD5-18*01 > 3_IGHJ4*01 & V3-4_IGLJ*01 mutant binding to DLL4 by ELISA

| Heavy Chain VH5-51_IGHD5-18*01 > 3_IGHJ4*01 | Light Chain V3-4_IGLJ*01 | 100 | 50 | 25 | 12.5 |
|---|---|---|---|---|---|
| G100K/G104T G24L/S28R/G35V Y105H (SEQ ID NO: 432) | Wildtype | 0.23 | 0.20 | 0.19 | 0.21 |
| G100K/G104T G24T/S28R/G35V Y105N (SEQ ID NO: 433) | Wildtype | 0.25 | 0.18 | 0.19 | 0.21 |
| G100K/G104T G24A/S28R/G35V Y107F (SEQ ID NO: 434) | Wildtype | 0.28 | 0.24 | 0.20 | 0.21 |
| G100K/G104T G24L/S28R/G35V D109Q (SEQ ID NO: 435) | Wildtype | 0.30 | 0.25 | 0.22 | 0.24 |
| G100K/G104T G24T/S28R/G35V | V91L/S96P | 1.00 | 0.81 | 0.58 | 0.45 |
| G100K | Wildtype | 0.20 | 0.19 | 0.18 | 0.19 |
| Wildtype | Wildtype | 0.17 | 0.16 | 0.18 | 0.17 |
| G104T | Wildtype | 0.17 | 0.17 | 0.18 | 0.19 |
| G100K/G104T | Wildtype | 0.18 | 0.18 | 0.16 | 0.18 |
| G100K/G104T G24T/S28R/G35V | Wildtype | 0.45 | 0.32 | 0.26 | 0.23 |
| G100K/G104T S28R | Wildtype | 0.26 | 0.23 | 0.20 | 0.18 |
| G100K/G104T G24A/S28R/G35V | V91L/S96P S52V | 0.95 | 0.74 | 0.60 | 0.43 |
| G100K/G104T G24L/S28R/G35V | V91L/S96P S52F | 0.99 | 0.69 | 0.49 | 0.42 |
| G100K/G104T G24T/S28R/G35V | V91L/S96P S52L | 1.02 | 0.78 | 0.58 | 0.43 |
| G100K/G104T G24A/S28R/G35V | V91L/S96P S52I | 1.04 | 0.82 | 0.60 | 0.40 |
| G100K/G104T G24L/S28R/G35V | V91L/S96P S52M | 1.01 | 0.80 | 0.59 | 0.41 |
| G100K/G104T G24T/S28R/G35V | V91L/S96P S52G | 1.14 | 1.02 | 0.90 | 0.63 |
| G100K/G104T G24A/S28R/G35V | V91L/S96P S52P | 1.00 | 0.79 | 0.59 | 0.43 |
| G100K/G104T G24L/S28R/G35V | V91L/S96P S52T | 0.99 | 0.79 | 0.62 | 0.41 |
| G100K/G104T G24T/S28R/G35V | V91L/S96P S52Y | 0.90 | 0.72 | 0.56 | 0.41 |
| G100K/G104T G24A/S28R/G35V | V91L/S96P S52H | 1.09 | 0.91 | 0.73 | 0.50 |
| G100K/G104T G24L/S28R/G35V | V91L/S96P S52Q | 0.96 | 0.81 | 0.67 | 0.47 |
| G100K/G104T G24T/S28R/G35V | V91L/S96P S52N | 1.05 | 0.90 | 0.86 | 0.65 |
| G100K/G104T G24T/S28R/G35V | V91L/S96P S52K | 1.23 | 1.03 | 0.79 | 0.56 |

Summary

As a result of affinity maturation, the affinity of parental Hit Fab VH5-51_IGHD5-18*01>3_IGHJ4*01 & V3-4_IGLJ1*01 for binding to DLL4 was increased 130-fold (see SPR data in Table 108 below). Parental Fab VH5-51_IGHD5-18*01>3_IGHJ4*01 & V3-4_IGLJ1*01 binds DLL4 with a $K_D$ of 4.8 μM. Heavy chain mutant Fab H:KT & L:wt has 13-fold increased affinity for DLL4 ($K_D$=355 nM). Affinity matured heavy and light chain mutant Fab H:KT TRV & L:wt has a $K_D$ of 36.2 nM, a 130-fold increase in binding affinity for DLL4. Affinity matured heavy and light chain mutant Fabs H:KT TRV & L:LP and H:KT TRV & L:LP S52G have a $K_D$ of 3.3 and 5.0 nM, respectively, a 1000-fold increase in binding affinity for DLL4.

TABLE 108

Binding affinity of VH5-51_IGHD5-18*01 > 3_IGHJ4*01 & V3-4_IGLJ1*01 DLL4 mutant Fabs by Surface Plasmon Resonance

| Heavy Chain | Light Chain | $k_a$ (×10$^5$) (M$^{-1}$s$^{-1}$) | $k_d$ (×10$^{-3}$) (s$^{-1}$) | $K_D$ (nM) |
|---|---|---|---|---|
| VH5-51_IGHD5-18*01 > 3_IGHJ4*01 (parental) | V3-4_IGLJ1*01 (parental) | n/a | n/a | 4800 (±200) |
| VH5-51_IGHD5-18*01 > 3_IGHJ4*01 G100K/G104T (KT) | V3-4_IGLJ1*01 | 0.645 (±0.092) | 0.023 (±0.004) | 355 (±7) |
| VH5-51_IGHD5-18*01 > 3_IGHJ4*01 G100K/G104T S28R (KT S28R) | V3-4_IGLJ1*01 | 7.4 (±0.6) | 0.0845 (±0.0050) | 114 (±6) |
| VH5-51_IGHD5-18*01 > 3_IGHJ4*01 G100K/G104T G24T/S28R/G35V (KT TRV) | V3-4_IGLJ1*01 | 20.90 (±6.24) | 0.0717 (±0.00351) | 36.2 (±8.5) |
| VH5-51_IGHD5-18*01 > 3_IGHJ4*01 G100K/G104T G24T/S28R/G35V (KT TRV) | V3-4_IGLJ1*01 M94R/S96M (RM) | 25.30 (±4.16) | 0.101 (±0.0153) | 40.3 (±9.3) |
| VH5-51_IGHD5-18*01 > 3_IGHJ4*01 G100K/G104T G24T/S28R/G35V (KT TRV) | V3-4_IGLJ1*01 V91L/S96P (LP) | 110 | 36 | 3.3 |
| VH5-51_IGHD5-18*01 > 3_IGHJ4*01 G100K/G104T G24T/S28R/G35V (KT TRV) | V3-4_IGLJ1*01 V91L/S96P S52G (LP S52G) | 29.6 | 14.7 | 5.0 |

Example 13

Germline Segment Swapping

In this example, two antibody "Hit" Fabs against DLL4, identified in Example 4 using the Multispot ECL binding assay, were subjected to mutagenesis by J-swapping or D-swapping of the $J_H$ or $D_H$ germline segments, respectively. J-swapping involves substitution of the parent "Hit" Fab $J_H$ germline segment with a different $J_H$ germline segment. D-swapping involves substitution of the parent "Hit" $D_H$ germline segment with a different $D_H$ germline segment. Since the $D_H$ germline segment constitutes the 5' end of the heavy chain CDR3 and $J_H$ segment constitutes the 3' end of the heavy chain CDR3, D-swapping and J-swapping allow for facile mutagenesis of this important antibody binding region.

A. Fab VH1-46_IGHD6-6*01_IGHJ1*01 & L6_IGKJ1*01

For Fab VH1-46_IGHD6-6*01_IGHJ1*01 & L6_IGKJ1*01, J-swapping of IGHJ1*01 with IGHJ2*01, IGHJ4*01, and IGHJ5*01 allowed analysis of the 3' end of CDR3 from amino acid residues A106 to H111 (see FIG. 4A). Purified Fab J-swapped mutants were tested for binding to DLL4 using the ECL assay as described in Example 4. The results are set forth in Tables 109-110 below. The results show that swapping of IGHJ1*01 with either IGHJ2*01, IGHJ4*01, or IGHJ5*01 reduced binding of the antibody to DLL4 as assessed by a decreased ECL signal compared to the parent template antibody containing the IGHJ1*01 $J_H$ germline segment.

TABLE 109

Fab VH1-46_IGHD6-6*01_IGHJ1*01 & L6_IGKJ1*01 J-swap binding data

| Heavy Chain | SEQ ID NO | Light Chain | SEQ ID NO | Signal/ Noise (0.04 µM) |
|---|---|---|---|---|
| VH1-46_IGHD6-6*01_IGHJ2*01 wildtype | 585 88 | L6_IGKJ1*01 L6_IGKJ1*01 | 107 107 | 0.8 1.7 |
| VH1-46_IGHD6-6*01_IGHJ4*01 | 586 | L6_IGKJ1*01 | 107 | 0.8 |
| VH1-46_IGHD6-6*01_IGHJ5*01 | 587 | L6_IGKJ1*01 | 107 | 0.8 |

TABLE 110

Fab VH1-46_IGHD6-6*01_IGHJ1*01 & L6_IGKJ1*01 J-swap mutant binding data

| Fab | | 0.02 µM Fab 30 µg/mL DLL4 | | 0.004 µM Fab 15 µg/mL DLL4 | |
|---|---|---|---|---|---|
| Heavy Chain | Light Chain | ECL Signal | Signal/ Noise | ECL Signal | Signal/ Noise |
| IGHJ2*01 | L6_IGKJ1*01 | 232 | 0.6 | 185 | 1.3 |
| wildtype | L6_IGKJ1*01 | 8714 | 23.0 | 4261 | 29.2 |
| IGHJ4*01 | L6_IGKJ1*01 | 203 | 0.5 | 178 | 1.2 |
| IGHJ5*01 | L6_IGKJ1*01 | 244 | 0.6 | 137 | 0.9 |

B. Fab VH5-51_IGHD5-18*01>3_IGHJ4*01 & V3-4_IGLJ*01

For Fab VH5-51_IGHD5-18*01>3_IGHJ4*01 & V3-4_IGLJ*01, J-swapping of IGHJ4*01 with IGHJ1*01, IGHJ3*01, and IGHJ5*01 allowed analysis of the 3' end of CDR3 from amino acid residues 106-110 (see FIG. 4B). D-swapping of IGHD5-18*01 with IGHD5-12*01 and IGHD5-24*01 allowed analysis of the 5' end of CDR3 from amino acid residues 100-104 (see FIG. 4C). Purified J-swapped and D-swapped mutants were tested for binding to DLL4 using the ECL assay as described in Example 4. The ECL results for binding to DLL4 are set forth in Tables 111-112 below. The results show that swapping of IGHJ4*01 with either IGHJ1*01, IGHJ3*01, or IGHJ5*01 reduced binding of the antibody to DLL4 as assessed by a decreased ECL signal compared to the parent template antibody containing the IGHJ4*01 $J_H$ germline segment. Additionally, swapping of IGHD5-18*01 with IGHD5-

12*01 or IGHD5-24*01 reduced binding of the antibody to DLL4 as assessed by a decreased ECL signal compared to the parent template antibody containing the IGHD5-18*01 $D_H$ germline segment.

TABLE 111

Fab VH5-51_IGHD5-18*01 > 3_IGHJ4*01 & V3-4_IGLJ*01
D-swap and J-swap mutant binding data

| Heavy Chain VH5-51_IGHD5-18*01 > 3_IGHJ4*01 | SEQ ID NO | Light Chain | SEQ ID NO | Signal/ Noise (0.04 μM) |
|---|---|---|---|---|
| IGHJ1*01 | 588 | V3-4_IGLJ1*01 | 108 | 1.2 |
| wildtype | 89 | V3-4_IGLJ1*01 | 108 | 14.7 |
| IGHJ3*01 | 589 | V3-4_IGLJ1*01 | 108 | 3.1 |
| IGHJ5*01 | 590 | V3-4_IGLJ1*01 | 108 | 1.2 |
| IGHD5-12*01 | 591 | V3-4_IGLJ1*01 | 108 | 1.2 |
| IGHD5-24*01 | 592 | V3-4_IGLJ1*01 | 108 | 1.3 |
| wildtype | 89 | V3-4_IGLJ1*01 | 108 | 15.5 |

TABLE 112

Fab VH5-51_IGHD5-18*01 > 3_IGHJ4*01 & V3-4_IGLJ*01
D-swap and J-swap mutant binding data

| Heavy Chain VH5-51_IGHD5-18*01_IGHJ4*01 | SEQ ID NO | Light Chain (SEQ ID NO: 108) | 0.1 μM Fab 30 μg/mL DLL4 Signal/ Noise | 0.02 μM Fab 15 μg/mL DLL4 Signal/ Noise |
|---|---|---|---|---|
| IGHJ1*01 | 588 | V3-4_IGLJ1*01 | 1.0 | 1.1 |
| wildtype | 89 | V3-4_IGLJ1*01 | 24.0 | 15.2 |
| IGHJ3*01 | 589 | V3-4_IGLJ1*01 | 7.9 | 3.5 |
| IGHJ5*01 | 590 | V3-4_IGLJ1*01 | 1.0 | 0.9 |
| IGHD5-12*01 | 591 | V3-4_IGLJ1*01 | 1.1 | 1.2 |
| IGHD5-24*01 | 592 | V3-4_IGLJ1*01 | 1.7 | 1.0 |

Example 14

Affinity Maturation of Fab VH3-23_IGHD2-21*01>3_IGHJ6*01 & V2-13_IGLJ2*01 Against Hepatocyte Growth Factor Receptor Fab VH3-23_IGHD2-21*01>3_IGHJ6*01 & V2-13_IGLJ2*01 (SEQ ID NOS:2803 and 594) against hepatocyte growth factor receptor (HGFR; C-Met) identified using the electroluminescence Meso Scale Discovery (MSD) multispot binding assay, was subjected to affinity maturation as described above in Examples 7-9. Mutations of amino acid residues were carried out by ligation of oligo pairs using method described in Example 1C.

i. Identification of the CDR Potential Binding Site

The amino acid sequence of the heavy chain (SEQ ID NO:2803) for the parent "Hit" VH3-23_IGHD2-21*01>3_IGHJ6*01 & V2-13_IGLJ2*01 was aligned with the amino acid sequences of three heavy chains (SEQ ID NOS:2797, 2799 and 2801) of three related "Hits" that also bind HGFR, albeit with slightly reduced affinity. These four Fabs share the same $V_H$ and $J_H$ germline segments. The sequence alignment is set forth in FIG. 5. Based on the alignment, amino acid residues were identified that differed between the "Hit" and the related "Hits", thus accounting for differences in binding of the "Hit" and related "Hits" for HGFR. The identified amino acid residues were located in CDR3, which was identified as the region of the heavy chain that is important for binding affinity.

ii. Alanine Scanning of Heavy Chain CDR3

CDR3 of the heavy chain sequence of parent Fab VH3-23_IGHD2-21*01>3_IGHJ6*01 & V2-13_IGLJ2*01 (SEQ ID NOS:2803 and 594) was subjected to alanine scanning mutagenesis and analyzed using the ECL multispot assay using 100 nM Fab. The results are set forth in Table 113 below. Mutation of amino acid residues E99, V102, V103, V104, and I105 with alanine and A106 with threonine caused a significant reduction in binding to HGFR as assessed by a decreased ECL signal. Mutation of H100, I101, I107, and S108 with alanine slightly reduced binding to HGFR as assessed by a decreased ECL signal.

TABLE 113

Binding of Fab VH3-23_IGHD2-21*01 > 3_IGHJ6*01 & V2-13_IGLJ2*01 CDR3 alanine mutants to HGFR

| | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Wt | 2803 | 2.4 | 2.8 | 18.5 | 1.7 | 1.6 | 0.9 | 12.7 | 16.5 | 1.3 |
| E99A | 595 | 2.5 | 2.3 | 5.8 | 1.9 | 1.4 | 1.1 | 9.7 | 11.6 | 1.4 |
| H100A | 596 | 1.3 | 1.8 | 14.1 | 1.0 | 1.0 | 1.0 | 4.8 | 7.2 | 2.2 |
| I101A | 597 | 2.8 | 3.0 | 14.8 | 1.7 | 1.2 | 1.1 | 23.2 | 26.6 | 1.5 |
| V102A | 598 | 1.4 | 1.4 | 5.3 | 1.0 | 1.0 | 1.0 | 4.9 | 8.3 | 1.4 |
| V103A | 599 | 0.9 | 1.1 | 2.2 | 0.8 | 0.7 | 0.9 | 3.9 | 6.2 | 1.0 |
| V104A | 600 | 1.3 | 1.4 | 2.3 | 1.3 | 1.1 | 1.1 | 2.6 | 5.3 | 1.4 |
| I105A | 601 | 1.0 | 1.1 | 1.1 | 1.2 | 0.9 | 1.1 | 1.2 | 5.5 | 1.1 |
| A106T | 602 | 1.3 | 1.4 | 6.9 | 1.5 | 1.3 | 1.4 | 2.3 | 3.2 | 1.9 |
| I107A | 603 | 4.8 | 4.3 | 13.7 | 2.7 | 1.5 | 1.1 | 19.6 | 43.6 | 3.6 |
| S108A | 604 | 1.9 | 2.0 | 12.9 | 1.5 | 1.3 | 1.2 | 4.8 | 9.5 | 2.3 | iii. NNK Mutagenesis of Y113

Amino acid residue Y113 of the heavy chain sequence of Fab VH3-23_IGHD2-21*01>3_IGHJ6*01 H100E/S108P (H:EP) & V2-13_IGLJ2*01 (SEQ ID NOS:593 and 594) was subjected to NNK mutagenesis and analyzed using the ECL multispot assay using 20 nM Fab. The results are set forth in Table 114 below. EP mutants Y113G, Y113I, Y113S, Y113T, Y113N, Y113N and Y113W had increased binding to HGFR as compared to heavy chain EP as evidenced by an increase in ECL signal.

TABLE 114

Binding of Fab VH3-23_IGHD2-21*01 > 3_IGHJ6*01 H100E/S108P (EP) & V2-13_IGLJ2*01 mutants to HGFR

|  | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Parent | 593 | 4.1 | 4.2 | 33.4 | 2.1 | 1.8 | 1.6 | 20.6 | 39.4 | 2.3 |
| Y113G | 605 | 11.7 | 8.4 | 104.6 | 2.3 | 1.7 | 1.7 | 27.5 | 126.1 | 2.3 |
| Y113I | 606 | 40.7 | 17.8 | 178.9 | 5.5 | 3.7 | 3.3 | 58.6 | 116.5 | 5.0 |
| Y113S | 607 | 19.1 | 9.2 | 133.1 | 3.3 | 2.3 | 1.8 | 41.0 | 142.2 | 3.0 |
| Y113P | 608 | 1.6 | 1.4 | 13.0 | 1.4 | 1.1 | 1.4 | 2.3 | 2.1 | 1.6 |
| Y113T | 609 | 35.4 | 18.9 | 185.0 | 6.1 | 4.1 | 3.1 | 65.9 | 174.4 | 5.5 |
| Y113H | 610 | 6.3 | 3.6 | 107.1 | 1.7 | 1.4 | 1.5 | 16.0 | 55.9 | 2.0 |
| Y113N | 611 | 28.4 | 11.0 | 122.6 | 4.3 | 2.4 | 1.6 | 38.5 | 114.2 | 3.1 |
| Y113E | 612 | 50.6 | 20.0 | 48.6 | 7.3 | 3.9 | 3.4 | 41.8 | 142.0 | 5.3 |
| Y113W | 613 | 21.8 | 11.7 | 130.8 | 4.2 | 3.9 | 1.9 | 44.3 | 169.8 | 3.3 |
| Y113R | 614 | 48.4 | 19.3 | 76.4 | 9.4 | 6.5 | 3.4 | 56.3 | 183.2 | 4.6 | iv. NNK Mutagenesis of Y109, Y110, Y111, Y112 and Y114

Amino acid residues Y109, Y110, Y111, Y112 and Y114 of the heavy chain sequence of Fab VH3-23_IGHD2-21*01>3_IGHJ6*01 H100E/S108P/Y113G (EPG) & V2-13_IGLJ2*01 (SEQ ID NOS:605 and 594) were subjected to NNK mutagenesis and analyzed using the ECL multispot assay using 20 nM Fab. The results are set forth in Table 115 below. Mutation of EPG heavy chain residue Y110 to isoleucine resulted in increased binding to HGFR as evidenced by an increased ECL signal as compared to heavy chain EPG. EPG mutants Y109W, Y112, Y112T and Y112W had slightly increased binding to HGFR as compared to heavy chain EPG as evidenced by a slight increase in ECL signal.

TABLE 115

Binding of Fab VH3-23_IGHD2-21*01 > 3_IGHJ6*01 H100E/S108P/Y113G (EPG) & V2-13_IGLJ2*01 Y109, Y110, Y111, Y112, and Y114 mutants to HGFR

|  | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Parent | 2803 | 4.1 | 4.2 | 33.4 | 2.1 | 1.8 | 1.6 | 20.6 | 39.4 | 2.3 |
| EPG | 605 | 11.7 | 8.4 | 104.6 | 2.3 | 1.7 | 1.7 | 27.5 | 126.1 | 2.3 |
| Y109L | 615 | 2.1 | 2.2 | 52.9 | 1.9 | 1.6 | 1.7 | 4.0 | 22.1 | 2.0 |
| Y109P | 616 | 1.5 | 1.6 | 1.8 | 1.1 | 1.1 | 1.4 | 1.9 | 1.8 | 1.6 |
| Y109T | 617 | 1.7 | 1.4 | 16.0 | 1.7 | 1.1 | 1.3 | 2.1 | 6.0 | 1.5 |
| Y109H | 618 | 1.7 | 1.4 | 27.7 | 1.2 | 1.1 | 1.2 | 3.9 | 18.3 | 1.4 |
| Y109Q | 619 | 1.3 | 1.7 | 14.7 | 1.3 | 1.3 | 1.1 | 2.2 | 3.1 | 1.2 |
| Y109D | 620 | 1.3 | 1.4 | 2.9 | 1.3 | 1.0 | 1.4 | 1.8 | 2.0 | 1.4 |
| Y109W | 621 | 16.1 | 11.1 | 125.3 | 4.4 | 2.4 | 1.5 | 32.0 | 168.8 | 4.3 |
| Y109R | 622 | 2.0 | 1.8 | 39.6 | 1.4 | 1.0 | 1.3 | 7.4 | 30.1 | 1.5 |
| Y109G | 623 | 1.4 | 2.0 | 8.7 | 1.5 | 1.5 | 1.6 | 2.7 | 11.1 | 1.9 |
| Y110I | 624 | 11.4 | 8.6 | 163.2 | 2.5 | 1.7 | 1.4 | 39.0 | 73.7 | 2.0 |
| Y110S | 625 | 1.0 | 1.3 | 13.1 | 0.8 | 1.0 | 1.1 | 1.9 | 4.5 | 1.2 |
| Y110P | 626 | 0.9 | 1.1 | 4.8 | 1.1 | 1.2 | 1.2 | 1.7 | 2.9 | 1.4 |
| Y110T | 627 | 0.8 | 1.8 | 21.1 | 2.3 | 1.6 | 1.8 | 1.0 | 3.5 | 1.8 |
| Y110H | 628 | 2.2 | 1.7 | 8.8 | 1.4 | 1.4 | 1.3 | 2.9 | 3.7 | 1.9 |
| Y110N | 629 | 1.2 | 0.9 | 2.3 | 1.3 | 0.8 | 0.9 | 1.2 | 1.6 | 1.2 |
| Y110E | 630 | 1.7 | 1.6 | 1.8 | 1.5 | 1.3 | 1.4 | 2.0 | 2.2 | 1.8 |
| Y110W | 631 | 16.5 | 7.6 | 110.2 | 3.2 | 2.1 | 2.3 | 38.8 | 116.8 | 3.9 |
| Y110R | 632 | 2.1 | 1.6 | 3.9 | 1.6 | 1.3 | 1.4 | 3.3 | 4.8 | 1.8 |
| Y110G | 633 | 1.3 | 1.5 | 1.0 | 1.6 | 1.0 | 1.4 | 0.8 | 2.0 | 1.3 |
| Y111I | 634 | 1.7 | 1.9 | 10.2 | 1.8 | 1.3 | 1.0 | 1.9 | 6.9 | 1.5 |
| Y111S | 635 | 2.1 | 1.8 | 23.9 | 1.9 | 1.2 | 1.3 | 5.0 | 30.1 | 1.7 |
| Y111P | 636 | 1.6 | 1.5 | 1.7 | 1.6 | 1.3 | 1.2 | 1.3 | 1.9 | 1.4 |

TABLE 115-continued

Binding of Fab VH3-23_IGHD2-21*01 > 3_IGHJ6*01 H100E/S108P/Y113G
(EPG) & V2-13_IGLJ2*01 Y109, Y110, Y111, Y112, and Y114 mutants to HGFR

|       | SEQ ID NO | ErbB2 | EGF R | HGF R | Notch-1 | CD44 | IGF-1 | P-Cad | EPO R | DLL4 |
|-------|-----------|-------|-------|-------|---------|------|-------|-------|-------|------|
| Y111T | 637 | 2.6 | 2.6 | 42.0 | 2.0 | 1.8 | 1.2 | 6.2 | 38.8 | 2.2 |
| Y111H | 638 | 3.0 | 2.9 | 37.5 | 1.5 | 1.3 | 1.2 | 7.7 | 49.8 | 1.6 |
| Y111N | 639 | 1.5 | 1.4 | 17.0 | 1.3 | 0.9 | 0.8 | 2.9 | 9.3 | 1.1 |
| Y111E | 640 | 1.5 | 1.4 | 2.2 | 1.5 | 1.1 | 1.4 | 2.3 | 2.9 | 1.5 |
| Y111W | 641 | 26.5 | 16.3 | 121.4 | 5.3 | 3.4 | 1.4 | 49.2 | 195.3 | 2.8 |
| Y111R | 642 | 3.3 | 2.6 | 24.3 | 2.3 | 1.4 | 1.3 | 15.7 | 22.6 | 1.4 |
| Y111G | 643 | 2.2 | 1.5 | 18.8 | 1.9 | 1.3 | 1.1 | 5.0 | 10.0 | 1.7 |
| Y112I | 644 | 25.0 | 21.5 | 126.2 | 10.4 | 6.5 | 2.1 | 43.1 | 81.7 | 3.7 |
| Y112S | 645 | 3.5 | 2.3 | 67.9 | 2.3 | 1.5 | 1.3 | 7.1 | 31.0 | 1.7 |
| Y112P | 646 | 2.3 | 1.8 | 41.8 | 1.4 | 1.1 | 1.1 | 5.0 | 32.2 | 1.5 |
| Y112T | 647 | 8.8 | 8.4 | 137.6 | 2.1 | 1.8 | 1.2 | 25.5 | 90.9 | 1.7 |
| Y112H | 648 | 3.4 | 2.7 | 86.6 | 1.8 | 1.4 | 1.7 | 9.7 | 40.6 | 1.8 |
| Y112N | 649 | 1.2 | 1.3 | 29.5 | 0.8 | 0.9 | 1.1 | 1.9 | 4.2 | 1.3 |
| Y112E | 650 | 1.4 | 1.5 | 7.3 | 1.2 | 1.1 | 1.2 | 2.0 | 4.7 | 1.3 |
| Y112W | 651 | 25.5 | 18.7 | 127.0 | 9.2 | 5.8 | 2.1 | 50.5 | 156.8 | 3.2 |
| Y112R | 652 | 5.9 | 3.7 | 120.5 | 2.7 | 1.6 | 1.5 | 30.0 | 85.1 | 2.6 |
| Y112G | 653 | 1.4 | 1.7 | 10.0 | 2.1 | 1.2 | 1.0 | 2.3 | 7.9 | 1.3 |
| Y114I | 654 | 11.4 | 7.1 | 82.2 | 2.6 | 1.8 | 1.4 | 22.6 | 161.8 | 2.4 |
| Y114S | 655 | 8.7 | 5.0 | 48.9 | 2.9 | 1.4 | 1.3 | 15.8 | 68.5 | 2.2 |
| Y114P | 656 | 1.4 | 1.2 | 2.7 | 1.4 | 1.1 | 0.9 | 1.3 | 2.3 | 1.1 |
| Y114T | 657 | 1.4 | 1.3 | 1.8 | 1.8 | 1.1 | 1.1 | 1.7 | 2.0 | 1.6 |
| Y114H | 658 | 12.5 | 8.7 | 67.5 | 3.3 | 1.8 | 1.4 | 27.0 | 119.7 | 2.3 |
| Y114N | 659 | 3.5 | 2.6 | 23.1 | 2.0 | 1.2 | 1.2 | 5.9 | 35.0 | 1.6 |
| Y114E | 660 | 7.4 | 6.8 | 18.2 | 3.3 | 1.5 | 1.5 | 13.9 | 69.2 | 2.2 |
| Y114W | 661 | 9.3 | 6.6 | 56.7 | 2.2 | 1.6 | 1.1 | 16.7 | 51.5 | 1.9 |
| Y114R | 662 | 6.4 | 4.3 | 70.4 | 2.0 | 1.4 | 1.1 | 15.6 | 61.8 | 1.9 |
| Y114G | 663 | 3.2 | 2.1 | 14.7 | 1.6 | 1.2 | 1.2 | 6.4 | 15.8 | 1.7 | v. Alanine Scanning of Heavy Chain CDR1

CDR1 of the heavy chain sequence of Fab VH3-23_IGHD2-21*01>3_IGHJ6*01 H100E/S108P/Y113G (H:EPG) & V2-13_IGLJ2*01 (SEQ ID NOS:605 and 594) was subjected to alanine scanning mutagenesis and analyzed using the ECL multispot assay using 20 nM Fab. The results are set forth in Table 116 below. Mutation of amino acid residues F27 and A33 with alanine resulted in reduced binding to HGFR as evidenced by a reduced ECL signal. Mutation of amino acid residues G26, T28, F29, S30, S31, Y32, M34, and S35 with alanine either improved binding or did not affect binding to HGFR as evidenced by an increased ECL signal or no change in ECL signal compared to the EPG triple mutant having no mutations in the light chain.

vi. Alanine Scanning of Heavy Chain CDR2

CDR2 of the heavy chain sequence of Fab VH3-23_IGHD2-21*01>3_IGHJ6*01 H100E/S108P/Y113G (H:EPG) & V2-13_IGLJ2*01 (SEQ ID NOS:605 and 594) was subjected to alanine scanning mutagenesis and analyzed using the ECL multispot assay using 20 nM Fab. The results are set forth in Table 117 below. Mutation of amino acid residues I51, G56, Y59, and A61 with alanine resulted in reduced binding to HGFR as evidenced by a reduced ECL signal. Double mutant S46A/G47A had reduced binding to HGFR as evidenced by a reduced ECL signal. Mutation of amino acid residues G53, S54 G55, S57, T58, Y60, D62, V64 and K65 with alanine either improved binding or did not affect binding to HGFR as evidenced by an increased ECL signal or no change in ECL signal compared to the H:EPG triple mutant having no mutations in the light chain.

TABLE 116

Binding of Fab VH3-23_IGHD2-21*01 > 3_IGHJ6*01 H100E/S108P/Y113G
(H:EPG) & V2-13_IGLJ2*01 CDR1 alanine mutants to HGFR

|        | SEQ ID NO | ErbB2 | EGF R | HGF R | Notch-1 | CD44 | IGF-1 | P-Cad | EPO R | DLL4 |
|--------|-----------|-------|-------|-------|---------|------|-------|-------|-------|------|
| G26A   | 664 | 12.1 | 7.5 | 110.9 | 2.3 | 2.0 | 1.6 | 29.4 | 161.3 | 2.7 |
| F27A   | 665 | 6.1 | 3.6 | 87.3 | 1.4 | 1.3 | 1.1 | 14.8 | 64.2 | 1.7 |
| T28A   | 666 | 13.3 | 8.7 | 140.3 | 2.2 | 1.8 | 1.3 | 32.6 | 180.5 | 2.2 |
| F29A   | 667 | 11.6 | 8.1 | 120.5 | 2.4 | 1.5 | 1.4 | 32.7 | 157.6 | 2.5 |
| S30A   | 668 | 11.4 | 8.9 | 118.3 | 2.4 | 1.7 | 1.3 | 26.8 | 153.7 | 2.0 |
| S31A   | 669 | 12.4 | 9.1 | 121.2 | 2.1 | 1.7 | 1.3 | 32.4 | 143.5 | 4.3 |
| Y32A   | 670 | 5.8 | 4.1 | 104.7 | 1.9 | 1.4 | 1.6 | 14.7 | 65.8 | 2.3 |
| A33T   | 671 | 6.3 | 5.3 | 35.7 | 1.7 | 1.2 | 1.1 | 25.9 | 114.3 | 1.8 |
| M34A   | 672 | 12.0 | 9.8 | 129.2 | 2.5 | 1.9 | 1.3 | 32.2 | 197.6 | 2.6 |
| S35A   | 673 | 12.0 | 8.3 | 108.5 | 2.6 | 1.8 | 1.3 | 32.4 | 184.4 | 2.4 |
| Parent | 2803 | 4.1 | 4.2 | 33.4 | 2.1 | 1.8 | 1.6 | 20.6 | 39.4 | 2.3 |
| EPG    | 605 | 11.7 | 8.4 | 104.6 | 2.3 | 1.7 | 1.7 | 27.5 | 126.1 | 2.3 |

TABLE 117

Binding of Fab VH3-23_IGHD2-21*01 > 3_IGHJ6*01 H100E/S108P (H:EP) or H100E/S108P/Y113G (H:EPG) & V2-13_IGLJ2*01 CDR2 alanine mutants to HGFR

|  | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Parent | 2803 | 4.1 | 4.2 | 33.4 | 2.1 | 1.8 | 1.6 | 20.6 | 39.4 | 2.3 |
| EPG | 605 | 11.7 | 8.4 | 104.6 | 2.3 | 1.7 | 1.7 | 27.5 | 126.1 | 2.3 |
| I51A | 674 | 9.4 | 5.3 | 77.4 | 2.8 | 1.6 | 1.3 | 20.3 | 112.6 | 2.2 |
| S52A/G53A | 675 | 8.3 | 5.2 | 85.0 | 2.2 | 1.5 | 1.4 | 16.7 | 75.6 | 2.3 |
| G53A | 676 | 16.7 | 10.9 | 159.2 | 3.9 | 2.5 | 1.8 | 36.5 | 222.6 | 3.1 |
| S54A | 677 | 15.1 | 8.9 | 115.2 | 2.8 | 1.9 | 1.3 | 33.4 | 160.7 | 2.4 |
| G55A | 678 | 11.1 | 7.7 | 111.3 | 2.5 | 1.7 | 1.3 | 26.9 | 143.0 | 2.1 |
| G56A | 679 | 9.5 | 6.8 | 79.4 | 2.7 | 1.6 | 1.4 | 23.6 | 100.0 | 2.3 |
| S57A | 680 | 12.9 | 8.7 | 124.0 | 3.4 | 1.8 | 1.7 | 33.0 | 150.8 | 2.5 |
| T58A | 681 | 15.9 | 9.6 | 167.0 | 3.1 | 1.5 | 1.2 | 36.9 | 158.1 | 2.3 |
| Y59A | 682 | 1.6 | 1.4 | 3.3 | 2.1 | 1.4 | 1.3 | 2.4 | 2.5 | 2.8 |
| Y60A | 683 | 11.5 | 6.2 | 112.7 | 2.6 | 1.5 | 1.2 | 25.3 | 109.8 | 2.3 |
| A61T | 684 | 11.2 | 7.1 | 81.4 | 2.9 | 2.0 | 1.6 | 20.9 | 146.7 | 2.6 |
| D62A | 685 | 21.7 | 11.6 | 154.4 | 3.5 | 2.0 | 1.4 | 45.8 | 244.1 | 2.4 |
| EP V64A | 686 | 16.5 | 9.1 | 100.9 | 3.0 | 2.2 | 1.2 | 30.6 | 172.9 | 2.7 |
| EP K65A | 687 | 12.1 | 7.1 | 95.8 | 3.0 | 1.7 | 1.4 | 21.6 | 120.4 | 2.5 |

Example 15

Affinity Maturation of Fab VH3-23_IGHD3-10*01>3_IGHJ6*01 & O12_IGKJ1*01 Against P-cadherin and Epo Fab VH3-23_IGHD3-10*01>3_IGHJ6*01 & V2-13_IGLJ2*01 (SEQ ID NOS:688 and 594) against P-cadherin and EPO, identified as described in Example 4 using the electroluminescence Meso Scale Discovery (MSD) multispot binding assay, was subjected to affinity maturation as described above in Examples 7-9.

vii. NNK Mutagenesis of CDR3 Amino Acid Residues R104, Y110, Y112, Y113, and Y114

CDR3 amino acid residues R104, Y110, Y112, Y113, and Y114 were mutagenized using NNK mutagenesis and tested for their ability to bind P-cadherin and EPO by ECL multispot assay. The results are set forth in Table 118 below. Mutant −3Y is a deletion mutant in which tyrosines 110, 111 and 112 were deleted. Mutation of amino acid residue Y115 to proline (Y115P) and Y110 to valine (Y110V) resulted an increased binding to both P-cadherin and EPO as compared to the wildtype template antibody as evidenced by an increase in ECL binding signal. Mutation of amino acid residue Y111 to arginine (Y111R) resulted in an increase in binding to P-cadherin as compared to wildtype as evidenced by an increase in ECL binding signal. Additionally, as set forth in Table 116 below, mutants Y115P, Y110V and Y111R all bind P-cadherin as evidenced by ELISA binding results.

TABLE 118

Binding of Fab VH3-23_IGHD3-10*01 > 3_IGHJ6*01 & O12_IGKJ1*01 NNK mutants

|  | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Y114N | 689 | 1.1 | 1.0 | 1.2 | 1.2 | 1.2 | 1.0 | 1.7 | 1.3 | 1.2 |
| Y114T | 690 | 0.8 | 0.8 | 1.2 | 0.7 | 0.9 | 0.7 | 1.3 | 1.2 | 0.9 |
| Y114I | 691 | 1.2 | 1.4 | 1.5 | 1.1 | 1.2 | 0.7 | 1.1 | 1.4 | 1.2 |
| Y115P | 692 | 3.4 | 2.7 | 4.3 | 1.7 | 1.3 | 1.7 | 27.2 | 37.0 | 4.2 |
| Y115R | 693 | 1.9 | 1.7 | 2.0 | 1.7 | 1.5 | 1.4 | 4.7 | 3.9 | 1.9 |
| Y115G | 694 | 1.9 | 2.0 | 2.1 | 1.7 | 1.5 | 1.9 | 9.7 | 17.0 | 2.7 |
| Y115E | 695 | 1.3 | 1.1 | 1.3 | 0.8 | 1.4 | 1.0 | 1.3 | 1.4 | 1.1 |
| R104A | 696 | 1.8 | 1.4 | 2.3 | 2.0 | 1.3 | 1.1 | 9.3 | 8.5 | 2.7 |
| -3Y | 697 | 1.2 | 1.4 | 1.1 | 0.7 | 0.9 | 1.0 | 1.1 | 1.7 | 1.3 |
| Y110V | 698 | 1.5 | 1.2 | 2.0 | 1.3 | 1.1 | 1.1 | 17.2 | 10.8 | 2.0 |
| Y110S | 699 | 1.6 | 1.2 | 1.4 | 1.4 | 1.4 | 1.1 | 1.5 | 1.4 | 1.4 |
| Y110P | 700 | 1.3 | 1.6 | 1.5 | 1.6 | 1.4 | 1.2 | 1.1 | 1.7 | 1.5 |
| Y110G | 701 | 1.3 | 1.2 | 0.9 | 1.4 | 0.9 | 1.2 | 1.0 | 1.4 | 1.3 |
| Y110R | 702 | 2.5 | 2.1 | 3.0 | 2.8 | 1.4 | 2.5 | 11.3 | 9.2 | 3.0 |
| Y111S | 703 | 1.2 | 1.3 | 1.3 | 1.3 | 1.0 | 0.9 | 1.4 | 1.5 | 1.2 |
| Y111D | 704 | 1.2 | 0.9 | 1.1 | 2.0 | 1.4 | 1.4 | 1.1 | 1.1 | 1.1 |
| Y111R | 705 | 2.5 | 2.4 | 3.2 | 3.0 | 1.5 | 1.9 | 11.9 | 7.3 | 2.9 |
| Y112A | 706 | 1.3 | 1.5 | 0.8 | 1.1 | 1.5 | 1.4 | 1.1 | 1.6 | 1.2 |
| Y112G | 707 | 2.9 | 2.1 | 2.3 | 3.3 | 2.5 | 2.3 | 1.4 | 1.6 | 2.2 |
| Y112Q | 708 | 1.5 | 1.2 | 1.4 | 1.7 | 1.4 | 1.6 | 3.0 | 2.4 | 1.8 |
| Y112P | 709 | 0.9 | 1.0 | 1.1 | 1.1 | 1.1 | 0.8 | 1.4 | 0.9 | 1.0 |
| Y112V | 710 | 1.6 | 1.2 | 1.3 | 1.4 | 1.0 | 0.8 | 9.8 | 4.3 | 2.0 |
| Y113H | 711 | 1.4 | 1.4 | 1.6 | 1.0 | 1.0 | 1.2 | 7.3 | 5.1 | 1.8 |

TABLE 118-continued

Binding of Fab VH3-23_IGHD3-10*01 > 3_IGHJ6*01 & O12_IGKJ1*01 NNK mutants

| | SEQ ID NO | ErbB2 | EGF R | HGF R | Notch-1 | CD44 | IGF-1 | P-Cad | EPO R | DLL4 |
|---|---|---|---|---|---|---|---|---|---|---|
| Y113L | 712 | 0.8 | 1.6 | 1.0 | 1.5 | 1.2 | 1.4 | 1.4 | 1.7 | 1.4 |
| Y113W | 713 | 1.8 | 1.5 | 2.0 | 1.4 | 1.4 | 1.2 | 5.6 | 4.0 | 1.8 |
| Y113E | 714 | 1.1 | 1.1 | 1.2 | 1.3 | 1.3 | 1.0 | 1.2 | 1.6 | 1.4 |
| Y113P | 715 | 1.3 | 1.4 | 1.4 | 1.4 | 0.8 | 1.2 | 2.0 | 2.0 | 1.3 |
| Y113K | 716 | 0.9 | 1.1 | 1.2 | 1.2 | 1.0 | 0.8 | 1.2 | 1.3 | 1.3 |
| Y114K | 717 | 0.8 | 0.9 | 0.9 | 1.0 | 0.8 | 0.6 | 1.0 | 1.2 | 1.1 |
| Y114F | 718 | 1.1 | 1.1 | 1.4 | 1.0 | 1.0 | 1.1 | 2.0 | 2.1 | 1.2 |
| Y114R | 719 | 2.0 | 2.0 | 2.4 | 2.4 | 1.6 | 1.5 | 2.9 | 2.3 | 2.4 |
| wt | 688 | 1.8 | 1.4 | 1.6 | 1.2 | 0.9 | 1.1 | 9.2 | 7.9 | 1.6 |
| wt | 688 | 1.6 | 1.5 | 2.0 | 1.4 | 1.3 | 1.4 | 9.5 | 9.3 | 1.7 |

Example 16

Binding to DLL4 Expressed on the Surface of CHO Cells

In this example, Fabs H:APFF VLTH & L:NDH LS (SEQ ID NOS:209 and 350; identified as exhibiting about 1.7 nM affinity as shown in Table 75) and H:KT TRV & L:LP S52G (SEQ ID NOS:430 and 543; identified as exhibiting about 5 nM affinity as shown in Table 108) were tested for their ability to bind to DLL4 expressed on the surface of CHO cells as detected by flow cytometry.

To generate a DLL4 expression construct, human DLL4 cDNA (SEQ ID NO:2905, Accession No. BC 106950; and encoding amino acids set forth in SEQ ID NO:2904, Accession No. AAI06951) in pCR-BluntII-TOPO (SEQ ID NO:2934) as a glycerol stock was obtained from Open Biosystems (Clone ID#40034887). The stock was streaked on kanamycin agar plates and a colony picked for purification of the DNA. DNA was obtained with Purelink™ Quick Plasmid Miniprep Kit (Invitrogen, Catalog # K210010).

Full-length DLL4 was digested out from the OpenBiosystems vector and ligated into pCDNA5/FRT (SEQ ID NO:2935; Invitrogen Catalog # K601001) between NheI and NotI. Ligation was performed with Rapid DNA Ligation Kit (Roche, Catalog #11 635 379 001) and cells transformed using heat shock into One Shot® Max Efficiency® DH5α™-T1® Competent Cells (Invitrogen, Catalog #12297016). Cells were selected on carbenicillin plates. Colonies were picked and inoculated overnight in luria broth (LB) containing 1:1000 100 mg/mL carbenicillin. Plasmid DNA was extracted by miniprep (Invitrogen; Catalog # K210011).

Using Invitrogen's Lipofectamine™ Transfection Reagent, pcDNA5/FRT containing full-length DLL4 and pOG44 recombinase vector (SEQ ID NO:2936; Invitrogen Catalog # K601001) were transfected into Invitrogen's Flp-In™-CHO Cell Line (Cat. No. R75807) according to Flp-In™ System protocol. Cells were approximately 90% confluent in a 12-well plate. Transfected cells were selected with 400 μg/ml Hygromycin after a couple days. Colonies were picked about 5 days after and transferred into a 10 cm² tissue culture dish. These cell lines were maintained with hygromycin selection CHO cells expressing full-length DLL4 and control CHO cells were detached from tissue culture plates (BD Falcon 10 cm²) using Accutase™ Enzyme Cell Detachment Medium (Cat#00-4555-56, eBioscience). After washing the cells in 2% Bovine Serum Albumin in Phosphate Buffered Saline (2% BSA/PBS), 10 nM to 50 nM Fab in 2% BSA/PBS was added and incubated at on ice for 30 minutes. The cells were washed one time with 2% BSA/PBS and mouse anti-human kappa-PE antibody (diluted 1:100, Cat# MH10514, Invitrogen) or mouse anti-human lambda-PE antibody (diluted 1:100, Cat# MH10614, Invitrogen) was added and incubated on ice for 10 minutes. Secondary antibody mouse anti-human kappa-PE alone (without Fab) was used as a control for DLL4-expressing CHO cells. The cells were then washed twice in 2% BSA/PBS and analyzed by flow cytometry on a BD FACSAria. The results show that the tested Fabs bind DLL4 expressed on the surface of CHO cells. Neither Fab showed significant binding to CHO cells without DLL4 over-expression.

Example 17

Inhibition of DLL4-Notch Interaction by Flow Cytometry

In this example, three DLL4 binding Fabs were functionally screened for their ability to block the binding of Notch-Fc to DLL4. In this assay, DLL4-expressing CHO cells were incubated in the presence of both Fab and biotinylated-Notch-Fc. Streptavidin-PE was used as a detection molecule. If Notch-Fc binds to DLL4-expressing CHO cells, these cells will be detected by a PE signal at 578 nm. Alternatively, if the Fab blocks the binding of Notch-Fc to DLL4, the DLL4-expressing CHO cells will not be labeled or detected. The tested Fabs included H:APFF VLTH & L:NDH LS (SEQ ID NOS:209 and 350), H:KT TRV & V3-4_IGLJ1*01 (SEQ ID NOS:430 and 108) and H:KT TRV & L:LP S52G (SEQ ID NOS:430 and 543).

In short, CHO cells expressing full-length DLL4 (CHO-DLL4) as described in Example 16 were detached from tissue culture plates using Accutase™ Enzyme Cell Detachment Medium (Cat#00-4555-56, eBioscience). Fab was 5-fold serially diluted in 2% BSA/PBS from a starting concentration of 50 nM. Notch-FC (cat#3647-TK-050, R&D Systems) was biotinylated following using EZ-Link NHS-Biotin Reagent (cat#20217. Pierce) according to the manufacturers instructions. Detached cells were treated with 250 nM biotinylated Notch-FC in 2% BSA/PBS and 30 μL Fab for 30 minutes on ice. PE-labeled streptavidin (Cat#21627, Pierce-Thermo Scientific) was then added to a final dilution of 1:5 followed by incubation for 10 minutes at room temperature. The cells were then washed twice in 2% BSA/PBS and analyzed by flow cytometry on a BD FACSAria.

The results are set forth in Table 119 below. All three Fabs effectively block Notch-Fc binding to CHO-DLL4. Fab H:APFF VLTH & L:NDH LS completely blocks the binding of Notch to DLL4 by 80% at a Fab concentration of 2 nM. Fab H:KT TRV & V3-4_IGLJ1*01 blocks the binding of Notch to DLL4 by 50% at a concentration of 50 nM Fab. Fab H:KT TRV & L:LP S52G blocks the binding of Notch to DLL4 by 80% at a concentration of 50 nM Fab.

TABLE 119

Inhibition of DLL4-Notch interaction

| Fab [nM] | H:APFF VLTH & L:NDH LS | H:KT TRV & L:wt | H:KT TRV & L:LP S52G |
| --- | --- | --- | --- |
| 50 | 30 | 141 | 105 |
| 10 | 30 | 244 | 190 |
| 2 | 117 | 448 | 250 |
| 0.4 | 277 | Not tested | 324 |
| 0 | 531 | 531 | 531 |

Example 18

IgG Cloning and Expression

In this example, Fab antibodies that bind to DLL4 were converted into IgGs by cloning into the pFUSE vectors. Briefly, sequences encoding heavy and light chains were cloned separately into the pFUSE family of vectors (pFUSE-hIgG2-Fc2, Cat# pfuse-hfc2, InvivoGen; SEQ ID NO:2938)) behind the included IL-2 signal sequence. These two vectors were then co-transformed into 293F cells and the protein was expressed and purified.

Light Chain: The Sequence encoding the Fab light chain (excluding the N-terminal *E. coli* sorting signal Met Ala) was amplified by PCR with primers containing EcoRI and NheI ends. The amplified Fab light chain was subcloned into pFUSE-hIgG2-Fc2, previously digested with EcoRI and NheI. The Fab light chain immediately follows the IL-2 signal sequence, and completely replaces the Fc sequence in pFUSE-hIgG2-Fc2.

Heavy Chain: A full-length IgG1 heavy chain sequence (SEQ ID NO:2922) also including a NheI site between VH and CH1-CH2-CH3 was synthesized by Genscript, amplified by PCR with primers containing EcoRI and XbaI ends, and subcloned into pFUSE-hIgG2-Fc2, previously digested with EcoRI and NheI. Ligation of the XbaI and NheI compatible cohesive ends eliminates both sties at this position, making the NheI site between VH and CH1-CH2-CH3 of the IgG1 heavy chain sequence unique. The sequence encoding Fab heavy chain (excluding the N-terminal *E. coli* sorting signal Met Ala) was amplified by PCR with EcoRI and NheI ends. The vector containing the full length IgG1 heavy chain was then digested with EcoRI and NheI, which removed the VH sequence, and the amplified Fab heavy chain was subcloned into the digested vector. Thus the Fab Heavy chain was subcloned between IL-2 and the IgGI heavy chain.

Protein Expression and Purification: To produce IgG, the heavy and light chain plasmids were co-transfected into 293F cells (Cat# R790-07, Invitrogen) using 293fectin (Cat#12347, Invitrogen) per manufacturer's instructions. Cells grown in serum-free 293Freestyle media (Cat#12338026, Invitrogen) were transfected at 1×106 cells/ml in 50 ml spinner flask. Cell culture media were harvested 3 and 6 days after transfection and pooled together for purification by column chromatography using Protein-G Sepharose (GE Healthcare). IgG elution fractions were pooled and dialysed into PBS.

Example 19

Activity of Antibodies by DLL4-Notch Interaction by a Reporter Assay

In this example, two DLL4 binding antibodies were assayed for their ability to inhibit DLL4-dependent Notch 1 signaling using a luciferase reporter assay. Reporter cells were generated by stably transfecting human glioma T98G cells, known for the presence of Notch 1 on their cell surface (see Purow et al. (2005) Cancer Res., 65:2353-63), with a Notch reporter plasmid (p6xCBF) containing six C promoter binding factor-1 (CBF-1) responsive elements (set forth in SEQ ID NO:2939; see Nefedova et al. (2004), Blood. 103(9):3503-10). Subsequent addition of DLL4-CHO cells (see Example 16 above) to the reporter T98G cells results in expression of firefly luciferase due to the Notch1-DLL4 interaction. Disruption of the Notch1-DLL4 by a DLL4 binding antibody therefore causes a decrease in luciferase expression.

A. Notch Reporter Plasmids

A reporter construct containing six C promoter binding factor-1 (CBF-1) response elements (set forth in SEQ ID NO:2939; CBF Notch-response elements are indicated by bold; ggtacctgagctcgctagcgatctggtgtaaacacgccgtgggaaaaaat-ttatggatctggtgtaaacacgccgtgggaaaaaatttatggagctcgctagcgat-ctggtgtaaacacgccgtgggaaaaaatttatggatctggtgtaaacacgccgtgg-gaaaaaatttatgctcgaggatctggtgtaaacacgccgtgggaaaaaatttatgg-atctggtgtaa acacgccgtgggaaaaaatttatgaagett;) was digested with KpnI and HindIII. The digested product was then into the luciferase reporter vectors pGL4.26 (SEQ ID NO:2940; Promega, Catalog # E8441)) at the KpnI and HindIII sites. The pGL4.26 vector allows for hygromycin selection, which facilitates the production of a cell line with a stably-integrated copy of the reporter. Also, the use of pGL4.26 eliminates the need to transiently transfect the reporter and normalize for variable transfection efficiency.

B. Assay

T98G cells from ATCC (No. CRL1690™) were plated onto a 96-well tissue culture plate at 20,000 cells per well in Eagle's Minimum Essential Media (EMEM, Invitrogen) supplemented with 10% Fetal Bovine Serum (BSA, Invitrogen) and 1× penicillin/streptomycin/glutamine (P/S/G, Invitrogen).

The following day, T98G cells were transfected with the Notch reporter construct expressing Firefly luciferase (p6xCBF) and stable integrants were selected with 200 ug/ml Hygromycin B (Invitrogen). CHO cells expressing DLL4 or control CHO cells were propagated in F12 media (Invitrogen) supplemented with 10% FBS and P/S/G. Separately, T98G Notch reporter cells ($2 \times 10^5$ cells/well) in EMEM with 10% FBS and P/S/G were plated onto 96-well tissue culture plates. Notch-expressing T98G cells were stimulated by CHO-DLL4 or control CHO cells ($1 \times 10^5$ cells/well). Media on T98G cells was replaced by 100 μl of serum free F12 media supplemented with P/S/G. Fabs H:APFF VLTH & L:NDH LS (SEQ ID NOS:209 and 350) and H:KT TRV & L:LP S52G (SEQ ID NOS:430 and 543) and their corresponding IgGs, and control Fab (that does not bind DLL4; VH6-1_IGHD6-13*01_IGHJ4*01 and V2-17_IGLJ2*01 set forth in SEQ ID NOS: 2152 and 2941, respectively) were added at 100, 20, 4 and 0.8 nM. In addition, the non-affinity matured germline parent Fabs also were tested to determine their Notch reporter response. For this, corresponding IgGs of VH5-51_IGHD5-18*01>3_IGHJ4*01 & V3-4_IGLJ1*01 (set forth in SEQ ID NOS: 89 and 108; the parent germline Fab of H:KT TRV & L:LP S52G) and VH1-46_IGHD6-6*01_IGHJ1*01 & L6_IGKJ1*01 (set forth in SEQ ID NOS:88 and 107; the parent germline Fab of H:APFF VLTH & L:NDH LS) were control IgG was added at 200, 100 and 20 nM.

After 24 hours, luciferase-reporter expression was measured with Bright-Glo luciferase assay reagent (Cat# E2620, Promega). Luminenscence was read using a Wallac Victor II model 1420 plate reader. Each condition was performed in quadruplicate.

The results are depicted in Tables 120 below. The results in Table 120 show that incubation of the T98G reporter cells with CHO-DLL4 resulted in 8- to 9-fold increase in Notch1 reporter levels compared to those incubated with CHO cells alone. The Notch1 activation remained constant in the presence of the control Fab that does not bind to DLL4. The activation was reduced in the presence of increasing concentration of anti-DLL4 antibody Fabs H:APFF VLTH & L:NDH LS and H:KT TRV & L:LP S52G. The reduction was even more pronounced with an IgG version of H:APFF VLTH & L:NDH LS ($IC_{50}$~6 nM), which was almost 10-fold more efficient than the corresponding Fab. The IgG version of H:KT TRV & L:LP S52G was also more effective than the corresponding Fab, displaying about 30% reduction in Notch1 activation at 0.8 nM. Neither Fab nor IgG form of H:KT TRV & L:LP S52G showed complete suppression of Notch1 activation at higher concentrations (>100 nM). The results show that the IgG H:APFF VLTH & L:NDH LS is a complete inhibitor, whereas IgG H:KT TRV & L:LP S52G is a partial antagonist of the DLL4-Notch activation.

TABLE 120

| Cell type | treatment | Conc [nM] | 1 | 2 | 3 | 4 | Avg ± SE |
|---|---|---|---|---|---|---|---|
| CHO-DLL4 | VH6-1 IGH36-13*01 IGHJ4*01 and V2-17_IGLJ2*01 (control Fab) | 0.8 | 4482 | 4541 | 3908 | 4221 | 4288 ± 144 |
| | | 4 | 4809 | 4921 | 4187 | 4520 | 4609 ± 164 |
| | | 20 | 5402 | 4988 | 4323 | 4546 | 4815 ± 240 |
| | | 100 | 4821 | 4813 | 4034 | 4473 | 4535 ± 186 |
| | H:KT TRV & L:LP S52G (Fab) | 0.8 | 4878 | 4716 | 4078 | 4278 | 4488 ± 186 |
| | | 4 | 4792 | 4771 | 4321 | 4469 | 4588 ± 116 |
| | | 20 | 4245 | 4371 | 4148 | 4075 | 4210 ± 64 |
| | | 100 | 3321 | 3483 | 3012 | 3083 | 3225 ± 109 |
| | H:KT TRV & L:LP S52G (IgG) | 0.8 | 3711 | 3485 | 3092 | 3292 | 3395 ± 132 |
| | | 4 | 3276 | 3339 | 3091 | 2911 | 3154 ± 97 |
| | | 20 | 3020 | 2904 | 2598 | 2652 | 2794 ± 101 |
| | | 100 | 2811 | 2545 | 2276 | 2519 | 2538 ± 109 |
| | H:APFF VLTH & L:NDH LS (Fab) | 0.8 | 4739 | 4886 | 3818 | 4076 | 4380 ± 257 |
| | | 4 | 4837 | 4877 | 4251 | 4667 | 4658 ± 143 |
| | | 20 | 4376 | 4482 | 3960 | 3993 | 4203 ± 133 |
| | | 100 | 2397 | 2285 | 2148 | 2169 | 2250 ± 58 |
| | H:APFF VLTH & L:NDH LS (IgG) | 0.8 | 4445 | 4521 | 3899 | 3985 | 4213 ± 158 |
| | | 4 | 4261 | 3862 | 3949 | 3765 | 3959 ± 107 |
| | | 20 | 1250 | 1269 | 1174 | 1191 | 1221 ± 23 |
| | | 100 | 757 | 807 | 678 | 688 | 733 ± 30 |
| CHO | VH6-1 IGH36-13*01 IGHJ4*01 and V2-17_IGLJ2*01 (control Fab) | 0.8 | 572 | 569 | 555 | 583 | 570 ± 6 |
| | | 4 | 557 | 547 | 539 | 450 | 523 ± 25 |
| | | 20 | 508 | 532 | 550 | 476 | 517 ± 16 |
| | | 100 | 488 | 487 | 491 | 464 | 483 ± 6 |

Since modifications will be apparent to those of skill in this art, it is intended that this invention be limited only by the scope of the appended claims.

SEQUENCE LISTING (2941 sequences)

SEQ ID NO: 1 - DNA, 45 bp, Artificial Sequence
  Description of Artificial Sequence: Synthetic oligonucleotide
  VH5-51_IGHD5-18*01>3_IGHJ4*01 R99A_F
gccatgtattactgtgcgagagccggatacagctatggttacgac

SEQ ID NO: 2 - DNA, 45 bp, Artificial Sequence
  Description of Artificial Sequence: Synthetic oligonucleotide
  VH5-51_IGHD5-18*01>3_IGHJ4*01 R99A_R
gtcgtaaccatagctgtatccggctctcgcacagtaatacatggc

SEQ ID NO: 3 - DNA, 43 bp, Artificial Sequence
  Description of Artificial Sequence: Synthetic oligonucleotide
  VH1-46_IGHD6-6*01_IGHJ1*01 E100A_F
gtgtattactgtgcgagagaggcctatagcagctcgtccgctg

SEQ ID NO: 4 - DNA, 43 bp, Artificial Sequence
  Description of Artificial Sequence: Synthetic oligonucleotide
  VH1-46_IGHD6-6*01_IGHJ1*01 E100A_R
cagcggacgagctgctataggcctctctcgcacagtaatacac

SEQ ID NO: 5 - DNA, 33 bp, Artificial Sequence
  Description of Artificial Sequence: Synthetic oligonucleotide
  EcoRI_F
ttgggcgaattccctagataattaattaggagg

SEQ ID NO: 6 - DNA, 28 bp, Artificial Sequence
  Description of Artificial Sequence: Synthetic oligonucleotide
  FLXhoI_R
ttaaacctcgagccgcggttcattaaag

SEQ ID NO: 7 - DNA, 40 bp, Artificial Sequence
  Description of Artificial Sequence: Synthetic oligonucleotide
  VH5-51_IGHD5-18*01>3_IGHJ4*01 G100_NNK_F
  modified_base (20)..(21): a, c, t, or g
gtattactgtgcgagacgtnnktacagctatggttacgac

SEQ ID NO: 8 - DNA, 40 bp, Artificial Sequence
  Description of Artificial Sequence: Synthetic oligonucleotide
  VH5-51_IGHD5-18*01>3_IGHJ4*01 G100_NNK_R
  modified_base (20)..(21): a, c, t, or g
gtcgtaaccatagctgtamnnacgtctcgcacagtaatac

SEQ ID NO: 9 - DNA, 35 bp, Artificial Sequence
  Description of Artificial Sequence: Synthetic oligonucleotide
  VH1-46_IGHD6-6*01_IGHJ1*01 S102_NNK_F
  modified_base (17)..(18): a, c, t, or g
tgcgagagaggggtatnnkagcagctggtacgact

SEQ ID NO: 10 - DNA, 35 bp, Artificial Sequence
  Description of Artificial Sequence: Synthetic oligonucleotide
  VH1-46_IGHD6-6*01_IGHJ1*01 S102_NNK_R
  modified_base (18)..(19): a, c, t, or g
agtcgtaccagctgctmnnatacccctctctcgca

SEQ ID NO: 11 - DNA, 39 bp, Artificial Sequence
  Description of Artificial Sequence: Synthetic oligonucleotide
  VH1-46_IGHD6-6*01_IGHJ1*01 CDR1_F
gagacctactatggttcgggtctctgggtgcgacaggcc

SEQ ID NO: 12 - DNA, 44 bp, Artificial Sequence
  Description of Artificial Sequence: Synthetic oligonucleotide
  VH1-46_IGHD6-6*01_IGHJ1*01 CDR2_F
gagacctactatggttcgggtctcaagttccagggcagagtcac

SEQ ID NO: 13 - DNA, 38 bp, Artificial Sequence
  Description of Artificial Sequence: Synthetic oligonucleotide
  VH1-46_IGHD6-6*01_IGHJ1*01 CDR3_F
gagacctactatggttcgggtctctggggccagggcac

SEQ ID NO: 14 - DNA, 39 bp, Artificial Sequence
  Description of Artificial Sequence: Synthetic oligonucleotide
  VH5-51_IGHD5-18*01>3_IGHJ4*01 CDR1_F
gagacctactatggttcgggtctctgggtgcgccagatg

SEQ ID NO: 15 - DNA, 43 bp, Artificial Sequence
  Description of Artificial Sequence: Synthetic oligonucleotide
  VH5-51_IGHD5-18*01>3_IGHJ4*01 CDR2_F
gagacctactatggttcgggtctccaggtcaccatctcagccg

SEQ ID NO: 16 - DNA, 40 bp, Artificial Sequence
  Description of Artificial Sequence: Synthetic oligonucleotide
  VH5-51_IGHD5-18*01>3_IGHJ4*01 CDR3_F
gagacctactatggttcgggtctctggggccaaggaaccc

SEQ ID NO: 17 - DNA, 45 bp, Artificial Sequence
  Description of Artificial Sequence: Synthetic oligonucleotide
  L6_IGKJ1*01 CDR1_F
gagacctactatggttcgggtctctggtaccaacagaaacctggc

SEQ ID NO: 18 - DNA, 39 bp, Artificial Sequence
  Description of Artificial Sequence: Synthetic oligonucleotide
  L6_IGKJ1*01 CDR2_F
gagacctactatggttcgggtctcggcatcccagccagg

SEQ ID NO: 19 - DNA, 40 bp, Artificial Sequence
  Description of Artificial Sequence: Synthetic oligonucleotide
  L6_IGKJ1*01 CDR3_F
gagacctactatggttcgggtctcttcggccaagggacca

SEQ ID NO: 20 - DNA, 42 bp, Artificial Sequence
  Description of Artificial Sequence: Synthetic oligonucleotide
  V3-4_IGLJ1*01 CDR1_F
gagacctactatggttcgggtctctggtaccagcagacccca

SEQ ID NO: 21 - DNA, 42 bp, Artificial Sequence
  Description of Artificial Sequence: Synthetic oligonucleotide
  V3-4_IGLJ1*01 CDR2_F
gagacctactatggttcgggtctcggggtccctgatcgcttc

SEQ ID NO: 22 - DNA, 42 bp, Artificial Sequence
  Description of Artificial Sequence: Synthetic oligonucleotide
  V3-4_IGLJ1*01 CDR3_F
gagacctactatggttcgggtctcttcggaactgggaccaag

SEQ ID NO: 23 - DNA, 20 bp, Artificial Sequence
  Description of Artificial Sequence: Synthetic oligonucleotide
  Lambda_BSA_F
gagtggagacgaccacaccc

SEQ ID NO: 24 - DNA, 43 bp, Artificial Sequence
  Description of Artificial Sequence: Synthetic oligonucleotide
  VH1-46_IGHD6-6*01_IGHJ1*01 CDR1_R
gagacccgaaccatagtaggtctcagatgccttgcaggaaacc

SEQ ID NO: 25 - DNA, 42 bp, Artificial Sequence
  Description of Artificial Sequence: Synthetic oligonucleotide
  VH1-46_IGHD6-6*01_IGHJ1*01 CDR2_R
gagacccgaaccatagtaggtctctcccatccactcaagccc

SEQ ID NO: 26 - DNA, 45 bp, Artificial Sequence
  Description of Artificial Sequence: Synthetic oligonucleotide
  VH1-46_IGHD6-6*01_IGHJ1*01 CDR3_R
gagacccgaaccatagtaggtctctctcgcacagtaatacacggc

SEQ ID NO: 27 - DNA, 47 bp, Artificial Sequence
  Description of Artificial Sequence: Synthetic oligonucleotide
  VH5-51_IGHD5-18*01>3_IGHJ4*01 CDR1_R
gagacccgaaccatagtaggtctcagaacccttacaggagatcttca

SEQ ID NO: 28 - DNA, 41 bp, Artificial Sequence
  Description of Artificial Sequence: Synthetic oligonucleotide
  VH5-51_IGHD5-18*01>3_IGHJ4*01 CDR2_R
gagacccgaaccatagtaggtctcccccatccactccaggc

SEQ ID NO: 29 - DNA, 45 bp, Artificial Sequence
  Description of Artificial Sequence: Synthetic oligonucleotide
  VH5-51_IGHD5-18*01>3_IGHJ4*01 CDR3_R
gagacccgaaccatagtaggtctctctcgcacagtaatacatggc

SEQ ID NO: 30 - DNA, 41 bp, Artificial Sequence
  Description of Artificial Sequence: Synthetic oligonucleotide
  L6_IGKJ1*01 CDR1_R
gagacccgaaccatagtaggtctcgcaggagagggtggctc

SEQ ID NO: 31 - DNA, 44 bp, Artificial Sequence
  Description of Artificial Sequence: Synthetic oligonucleotide
  L6_IGKJ1*01 CDR2_R
gagacccgaaccatagtaggtctcatagatgaggagcctgggag

SEQ ID NO: 32 - DNA, 50 bp, Artificial Sequence
  Description of Artificial Sequence: Synthetic oligonucleotide
  L6_IGKJ1*01 CDR3_R
gagacccgaaccatagtaggtctcacagtaataaactgcaaaatcttcag

SEQ ID NO: 33 - DNA, 46 bp, Artificial Sequence
  Description of Artificial Sequence: Synthetic oligonucleotide
  V3-4_IGLJ1*01 CDR1_R
gagacccgaaccatagtaggtctcacaagtgagtgtgactgtccct

SEQ ID NO: 34 - DNA, 42 bp, Artificial Sequence
  Description of Artificial Sequence: Synthetic oligonucleotide
  V3-4_IGLJ1*01 CDR2_R
gagacccgaaccatagtaggtctcgtagatgagcgtgcgtgg

SEQ ID NO: 35 - DNA, 51 bp, Artificial Sequence
  Description of Artificial Sequence: Synthetic oligonucleotide
  V3-4_IGLJ1*01 CDR3_R
gagacccgaaccatagtaggtctcacagtaataatcagattcatcatctgc

SEQ ID NO: 36 - DNA, 45 bp, Artificial Sequence
  Description of Artificial Sequence: Synthetic oligonucleotide
  A_ILPTH_F
tgggaataattctccctactggtcatagcacaagctacgcacaga

SEQ ID NO: 37 - DNA, 45 bp, Artificial Sequence
  Description of Artificial Sequence: Synthetic oligonucleotide
  A_VLPTH_F
tgggaatagtgctccctactggtcatagcacaagctacgcacaga

SEQ ID NO: 38 - DNA, 45 bp, Artificial Sequence
  Description of Artificial Sequence: Synthetic oligonucleotide
  A_ALPTH_F
tgggaatagctctccctactggtcatagcacaagctacgcacaga

SEQ ID NO: 39 - DNA, 45 bp, Artificial Sequence
  Description of Artificial Sequence: Synthetic oligonucleotide
  A_GLPTH_F
tgggaataggcctccctactggtcatagcacaagctacgcacaga

SEQ ID NO: 40 - DNA, 45 bp, Artificial Sequence
  Description of Artificial Sequence: Synthetic oligonucleotide
  A_TLPTH_F
tgggaataaccctccctactggtcatagcacaagctacgcacaga

SEQ ID NO: 41 - DNA, 45 bp, Artificial Sequence
  Description of Artificial Sequence: Synthetic oligonucleotide
  A_SLPTH_F
tgggaatatccctccctactggtcatagcacaagctacgcacaga

SEQ ID NO: 42 - DNA, 45 bp, Artificial Sequence
  Description of Artificial Sequence: Synthetic oligonucleotide
  A_YLPTH_F
tgggaatatacctccctactggtcatagcacaagctacgcacaga

SEQ ID NO: 43 - DNA, 45 bp, Artificial Sequence
  Description of Artificial Sequence: Synthetic oligonucleotide
  A_WLPTH_F
tgggaatatggctccctactggtcatagcacaagctacgcacaga

SEQ ID NO: 44 - DNA, 45 bp, Artificial Sequence
  Description of Artificial Sequence: Synthetic oligonucleotide
  A_HLPTH_F
tgggaatacacctccctactggtcatagcacaagctacgcacaga

SEQ ID NO: 45 - DNA, 45 bp, Artificial Sequence
  Description of Artificial Sequence: Synthetic oligonucleotide
  A_RLPTH_F
tgggaatacgcctccctactggtcatagcacaagctacgcacaga

SEQ ID NO: 46 - DNA, 45 bp, Artificial Sequence
  Description of Artificial Sequence: Synthetic oligonucleotide
  A_ELPTH_F
tgggaatagaactccctactggtcatagcacaagctacgcacaga

SEQ ID NO: 47 - DNA, 45 bp, Artificial Sequence
  Description of Artificial Sequence: Synthetic oligonucleotide
  A_NLPTH_F
tgggaataaacctccctactggtcatagcacaagctacgcacaga

SEQ ID NO: 48 - DNA, 45 bp, Artificial Sequence
  Description of Artificial Sequence: Synthetic oligonucleotide
  A_TLVTH_F
tgggaataaccctcgtgactggtcatagcacaagctacgcacaga

SEQ ID NO: 49 - DNA, 45 bp, Artificial Sequence
  Description of Artificial Sequence: Synthetic oligonucleotide
  A_TLATH_F
tgggaataaccctcgctactggtcatagcacaagctacgcacaga

SEQ ID NO: 50 - DNA, 45 bp, Artificial Sequence
  Description of Artificial Sequence: Synthetic oligonucleotide
  A_TLGTH_F
tgggaataaccctcggcactggtcatagcacaagctacgcacaga

SEQ ID NO: 51 - DNA, 45 bp, Artificial Sequence
  Description of Artificial Sequence: Synthetic oligonucleotide
  A_TLTTH_F
tgggaataaccctcaccactggtcatagcacaagctacgcacaga

SEQ ID NO: 52 - DNA, 45 bp, Artificial Sequence
  Description of Artificial Sequence: Synthetic oligonucleotide
  A_TLSTH_F
tgggaataaccctctccactggtcatagcacaagctacgcacaga

SEQ ID NO: 53 - DNA, 45 bp, Artificial Sequence
  Description of Artificial Sequence: Synthetic oligonucleotide
  A_TLYTH_F
tgggaataaccctctacactggtcatagcacaagctacgcacaga

SEQ ID NO: 54 - DNA, 45 bp, Artificial Sequence
  Description of Artificial Sequence: Synthetic oligonucleotide
  A_TLWTH_F
tgggaataaccctctggactggtcatagcacaagctacgcacaga

SEQ ID NO: 55 - DNA, 45 bp, Artificial Sequence
  Description of Artificial Sequence: Synthetic oligonucleotide
  A_TLHTH_F
tgggaataaccctccacactggtcatagcacaagctacgcacaga

SEQ ID NO: 56 - DNA, 45 bp, Artificial Sequence
  Description of Artificial Sequence: Synthetic oligonucleotide
  A_TLRTH_F
tgggaataaccctccgcactggtcatagcacaagctacgcacaga

SEQ ID NO: 57 - DNA, 45 bp, Artificial Sequence
  Description of Artificial Sequence: Synthetic oligonucleotide
  A_TLETH_F
tgggaataaccctcgaaactggtcatagcacaagctacgcacaga

SEQ ID NO: 58 - DNA, 45 bp, Artificial Sequence; identical to SEQ ID NO: 50
  Description of Artificial Sequence: Synthetic oligonucleotide
  A_TLNTH_F

SEQ ID NO: 59 - DNA, 45 bp, Artificial Sequence
  Description of Artificial Sequence: Synthetic oligonucleotide
  A_TLMTH_F
tgggaataaccctcatgactggtcatagcacaagctacgcacaga

SEQ ID NO: 60 - DNA, 45 bp, Artificial Sequence
  Description of Artificial Sequence: Synthetic oligonucleotide
  A_ILPTH_R
aacttctgtgcgtagcttgtgctatgaccagtagggagaattatt

SEQ ID NO: 61 - DNA, 45 bp, Artificial Sequence
  Description of Artificial Sequence: Synthetic oligonucleotide
  A_VLPTH_R
aacttctgtgcgtagcttgtgctatgaccagtagggagcactatt

SEQ ID NO: 62 - DNA, 45 bp, Artificial Sequence
  Description of Artificial Sequence: Synthetic oligonucleotide
  A_ALPTH_R
aacttctgtgcgtagcttgtgctatgaccagtagggagagctatt

SEQ ID NO: 63 - DNA, 45 bp, Artificial Sequence
  Description of Artificial Sequence: Synthetic oligonucleotide
  A_GLPTH_R
aacttctgtgcgtagcttgtgctatgaccagtagggaggcctatt

SEQ ID NO: 64 - DNA, 45 bp, Artificial Sequence
  Description of Artificial Sequence: Synthetic oligonucleotide
  A_TLPTH_R
aacttctgtgcgtagcttgtgctatgaccagtagggagggttatt

SEQ ID NO: 65 - DNA, 45 bp, Artificial Sequence
  Description of Artificial Sequence: Synthetic oligonucleotide
  A_SLPTH_R
aacttctgtgcgtagcttgtgctatgaccagtagggagggatatt

SEQ ID NO: 66 - DNA, 45 bp, Artificial Sequence
  Description of Artificial Sequence: Synthetic oligonucleotide
  A_YLPTH_R
aacttctgtgcgtagcttgtgctatgaccagtagggaggtatatt

SEQ ID NO: 67 - DNA, 45 bp, Artificial Sequence
  Description of Artificial Sequence: Synthetic oligonucleotide
  A_WLPTH_R
aacttctgtgcgtagcttgtgctatgaccagtagggagccatatt

SEQ ID NO: 68 - DNA, 45 bp, Artificial Sequence
  Description of Artificial Sequence: Synthetic oligonucleotide
  A_HLPTH_R
aacttctgtgcgtagcttgtgctatgaccagtagggaggtgtatt

SEQ ID NO: 69 - DNA, 45 bp, Artificial Sequence
  Description of Artificial Sequence: Synthetic oligonucleotide
  A_RLPTH_R
aacttctgtgcgtagcttgtgctatgaccagtagggaggcgtatt

SEQ ID NO: 70 - DNA, 45 bp, Artificial Sequence
  Description of Artificial Sequence: Synthetic oligonucleotide
  A_ELPTH_R
aacttctgtgcgtagcttgtgctatgaccagtagggagttctatt

SEQ ID NO: 71 - DNA, 45 bp, Artificial Sequence
  Description of Artificial Sequence: Synthetic oligonucleotide
  A_NLPTH_R
aacttctgtgcgtagcttgtgctatgaccagtagggaggtttatt

SEQ ID NO: 72 - DNA, 45 bp, Artificial Sequence
  Description of Artificial Sequence: Synthetic oligonucleotide
  A_TLVTH_R
aacttctgtgcgtagcttgtgctatgaccagtcacgagggttatt

SEQ ID NO: 73 - DNA, 45 bp, Artificial Sequence
  Description of Artificial Sequence: Synthetic oligonucleotide
  A_TLATH_R
aacttctgtgcgtagcttgtgctatgaccagtagcgagggttatt

SEQ ID NO: 74 - DNA, 45 bp, Artificial Sequence
  Description of Artificial Sequence: Synthetic oligonucleotide
  A_TLGTH_R
aacttctgtgcgtagcttgtgctatgaccagtgccgagggttatt

SEQ ID NO: 75 - DNA, 45 bp, Artificial Sequence
  Description of Artificial Sequence: Synthetic oligonucleotide
  A_TLTTH_R
aacttctgtgcgtagcttgtgctatgaccagtggtgagggttatt

SEQ ID NO: 76 - DNA, 45 bp, Artificial Sequence
  Description of Artificial Sequence: Synthetic oligonucleotide
  A_TLSTH_R
aacttctgtgcgtagcttgtgctatgaccagtggagagggttatt

SEQ ID NO: 77 - DNA, 45 bp, Artificial Sequence
  Description of Artificial Sequence: Synthetic oligonucleotide
  A_TLYTH_R
aacttctgtgcgtagcttgtgctatgaccagtgtagagggttatt

SEQ ID NO: 78 - DNA, 45 bp, Artificial Sequence
  Description of Artificial Sequence: Synthetic oligonucleotide
  A_TLWTH_R
aacttctgtgcgtagcttgtgctatgaccagtccagagggttatt

SEQ ID NO: 79 - DNA, 45 bp, Artificial Sequence
  Description of Artificial Sequence: Synthetic oligonucleotide
  A_TLHTH_R
aacttctgtgcgtagcttgtgctatgaccagtgtggagggttatt

SEQ ID NO: 80 - DNA, 45 bp, Artificial Sequence
  Description of Artificial Sequence: Synthetic oligonucleotide
  A_TLRTH_R
aacttctgtgcgtagcttgtgctatgaccagtgcggagggttatt

SEQ ID NO: 81 - DNA, 45 bp, Artificial Sequence
  Description of Artificial Sequence: Synthetic oligonucleotide
  A_TLETH_R
aacttctgtgcgtagcttgtgctatgaccagtttcgagggttatt

SEQ ID NO: 82 - DNA, 45 bp, Artificial Sequence; identical to SEQ ID NO: 74
  Description of Artificial Sequence: Synthetic oligonucleotide
  A_TLNTH_R

SEQ ID NO: 83 - DNA, 45 bp, Artificial Sequence
  Description of Artificial Sequence: Synthetic oligonucleotide
  A_TLMTH_R
aacttctgtgcgtagcttgtgctatgaccagtcatgagggttatt

SEQ ID NO: 84 - DNA, 5476 bp, Artificial Sequence
  Description of Artificial Sequence: Synthetic polynucleotide
  Plasmid A (heavy chain with Flag-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 85 - DNA, 5491 bp, Artificial Sequence
  Description of Artificial Sequence: Synthetic polynucleotide
  Plasmid D (heavy chain with Flag-LPETG-H6 tag)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtcccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaaaaagaatatcgcatttcttcttgcatctatgttcgttttttcaattgctacgaacgccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaagacgtcgattacaaggatgacgacgataagcttccggaaaccggtcatcatcaccatcaccattaattaattaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatct

SEQ ID NO: 86 - DNA, 4980 bp, Artificial Sequence
  Description of Artificial Sequence: Synthetic polynucleotide
  Plasmid C (for kappa light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctaggtaattaattaggaggaatttaaaatgaagaaaaacatcgcctttctgcttgcatcgatgttcgtgttttcgatcgcgaccaacgccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttaagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 87 - DNA, 4986 bp, Artificial Sequence
  Description of Artificial Sequence: Synthetic polynucleotide
  Plasmid E (for lambda light chain)
catgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtccgggtctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcataatgtgcctgtcaaatggacgaagcagggattctgcaaaccctatgctactccgtcaagccgtcaattgtctgattcgttaccaattatgacaacttgacggctacatcattcactttttcttcacaaccggcacggaactcgctcgggctggccccggtgcattttttaaatacccgcgagaaatagagttgatcgtcaaaaccaacattgcgaccgacggtggcgataggcatccgggtggtgctcaaaagcagcttcgcctggctgatacgttggtcctcgcgccagcttaagacgctaatccctaactgctggcggaaaagatgtgacagacgcgacggcgacaagcaaacatgctgtgcgacgctggcgatatcaaaattgctgtctgccaggtgatcgctgatgtactgacaagcctcgcgtacccgattatccatcggtggatggagcgactcgttaatcgcttccatgcgccgcagtaacaattgctcaagcagatttatcgccagcagctccgaatagcgcccttccccttgcccggcgttaatgatttgcccaaacaggtcgctgaaatgcggctggtgcgcttcatccgggcgaaagaaccccgtattggcaaatattgacggccagttaagccattcatgccagtaggcgcgcggacgaaagtaaacccactggtgataccattcgcgagcctccggatgacgaccgtagtgatgaatctctcctggcgggaacagcaaaatatcacccggtcggcaaacaaattctcgtccctgatttttcaccaccccctgaccgcgaatggtgagattgagaatataacctttcattcccagcggtcggtcgataaaaaaatcgagataaccgttggcctcaatcggcgttaaacccgccaccagatgggcattaaacgagtatcccggcagcaggggatcattttgcgcttcagccatacttttcatactcccgccattcagagaagaaaccaattgtccatattgcatcagacattgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgttttttgggcgaattccctagataattaattaggaggaatttaaaatgaagaaaaacatcgcctttctgcttgcatcgatgttcgtgttttcgatcgcgaccaacgccatggcgcagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcataagcggccgctcccacagccgccagttccgctggcggcattttaactttctttaatgaaccgcggctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacaaggcctattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgactagtgcttggattctcaccaataaaaaacgcccggcggcaaccgagcgttctgaacaaatccagatggagttctgaggtcattactggatctatcaacaggagtccaagcgagctcgatatcaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatagtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccagatatcgacgtctaagaaaccattattat

SEQ ID NO: 88 - protein, 124 aa, Artificial Sequence
  Description of Artificial Sequence: Synthetic polypeptide
  VH1-46_IGHD6-6*01_IGHJ1*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFQHWGQGTLVTVSSAS

SEQ ID NO: 89 - protein, 123 aa, Artificial Sequence
  Description of Artificial Sequence: Synthetic polypeptide
  VH5-51_IGHD5-18*01>3_IGHJ4*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYDYFDYWGQGTLVTVSSAS

SEQ ID NO: 90 - protein, 130 aa, Artificial Sequence
  Description of Artificial Sequence: Synthetic polypeptide
  VH6-1_IGHD3-3*01_IGHJ4*01
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDFWSGYYTDYFDYWGQGTLVTVSSAS

SEQ ID NO: 91 - protein, 125 aa, Artificial Sequence
  Description of Artificial Sequence: Synthetic polypeptide
  VH4-31_IGHD1-26*01_IGHJ2*01
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGYSGSYYYWYFDLWGRGTLVTVSSAS

SEQ ID NO: 92 - protein, 127 aa, Artificial Sequence
  Description of Artificial Sequence: Synthetic polypeptide
  VH1-46_IGHD3-10*01_IGHJ4*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREYYYGSGSYYNDYFDYWGQGTLVTVSSAS

SEQ ID NO: 93 - protein, 124 aa, Artificial Sequence
  Description of Artificial Sequence: Synthetic polypeptide
  VH1-46_IGHD6-13*01_IGHJ4*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYSSSWYDYFDYWGQGTLVTVSSAS

SEQ ID NO: 94 - protein, 121 aa, Artificial Sequence
  Description of Artificial Sequence: Synthetic polypeptide
  VH4-28_IGHD7-27*01_IGHJ1*01
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARTNWGAEYFQHWGQGTLVTVSSAS

SEQ ID NO: 95 - protein, 122 aa, Artificial Sequence
  Description of Artificial Sequence: Synthetic polypeptide
  VH4-31_IGHD7-27*01_IGHJ5*01
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARANWGDNWFDSWGQGTLVTVSSAS

SEQ ID NO: 96 - protein, 123 aa, Artificial Sequence
  Description of Artificial Sequence: Synthetic polypeptide
  VH2-5_IGHD7-27*01_IGHJ2*01
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRPNWGYWYFDLWGRGTLVTVSSAS

SEQ ID NO: 97 - protein, 121 aa, Artificial Sequence
  Description of Artificial Sequence: Synthetic polypeptide
  VH1-46_IGHD7-27*01_IGHJ2*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARANWGYWYFDLWGRGTLVTVSSAS

SEQ ID NO: 98 - protein, 127 aa, Artificial Sequence
  Description of Artificial Sequence: Synthetic polypeptide
  VH1-69_IGHD1-1*01_IGHJ6*01
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGYNWNDDYYYYYGMDVWGQGTTVTVSSAS

SEQ ID NO: 99 - protein, 128 aa, Artificial Sequence
  Description of Artificial Sequence: Synthetic polypeptide
  VH1-46_IGHD2-15*01_IGHJ2*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREGYCSGGSCYSYWYFDLWGRGTLVTVSSAS

SEQ ID NO: 100 - protein, 119 aa, Artificial Sequence
  Description of Artificial Sequence: Synthetic polypeptide
  VH4-34_IGHD7-27*01_IGHJ4*01
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARANWGDYFDYWGQGTLVTVSSAS

SEQ ID NO: 101 - protein, 123 aa, Artificial Sequence
  Description of Artificial Sequence: Synthetic polypeptide
  VH1-3_IGHD4-23*01_IGHJ4*01
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARDDYGGNSDYFDYWGQGTLVTVSSAS

SEQ ID NO: 102 - protein, 132 aa, Artificial Sequence
  Description of Artificial Sequence: Synthetic polypeptide
  VH1-8_IGHD2-2*01_IGHJ6*01
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYCSSTSCYADYYYYYGMDVWGQGTTVTVSSAS

SEQ ID NO: 103 - protein, 129 aa, Artificial Sequence
  Description of Artificial Sequence: Synthetic polypeptide
  VH4-31_IGHD2-15*01_IGHJ2*01
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCSGGSCYSYWYFDLWGRGTLVTVSSAS

SEQ ID NO: 104 - protein, 132 aa, Artificial Sequence
  Description of Artificial Sequence: Synthetic polypeptide
  VH3-23_IGHD3-10*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYYGMDVWGQGTLVTVSSAS

SEQ ID NO: 105 - protein, 127 aa, Artificial Sequence
  Description of Artificial Sequence: Synthetic polypeptide
  VH3-23_IGHD3-10*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYAFDVWGQGTLVTVSSAS

SEQ ID NO: 106 - protein, 123 aa, Artificial Sequence
  Description of Artificial Sequence: Synthetic polypeptide
  VH5-51_IGHD6-25*01_IGHJ4*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGYSSGYDYFDYWGQGTLVTVSSAS

SEQ ID NO: 107 - protein, 110 aa, Artificial Sequence
  Description of Artificial Sequence: Synthetic polypeptide
  L6_IGKJ1*01
EIVLTQSPATLSLSPGERATLSCRASQSVSSYLAWYQQKPGQAPRLLIYDASNRATGIPARFSGSGSGTDFTLTISSLEPEDFAVYYCQQRSNWPPWTFGQGTKVEIKRT

SEQ ID NO: 108 - protein, 111 aa, Artificial Sequence
  Description of Artificial Sequence: Synthetic polypeptide
  V3-4_IGLJ1*01
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 109 - protein, 116 aa, Artificial Sequence
  Description of Artificial Sequence: Synthetic polypeptide
  V4-3_IGLJ4*01
QPVLTQPTSLSASPGASARLTCTLRSGINLGSYRIFWYQQKPESPPRYLLSYYSDSSKHQGSGVPSRFSGSKDASSNAGILVISGLQSEDEADYYCMIWHSSASFVFGGGTQLIIL

SEQ ID NO: 110 - protein, 111 aa, Artificial Sequence
  Description of Artificial Sequence: Synthetic polypeptide
  A27_IGKJ1*01
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPWTFGQGTKVEIKRT

SEQ ID NO: 111 - protein, 116 aa, Artificial Sequence
  Description of Artificial Sequence: Synthetic polypeptide
  B3_IGKJ1*01
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPWTFGQGTKVEIKRT

SEQ ID NO: 112 - protein, 110 aa, Artificial Sequence
  Description of Artificial Sequence: Synthetic polypeptide
  L2_IGKJ1*01
EIVMTQSPATLSVSPGERATLSCRASQSVSSNLAWYQQKPGQAPRLLIYGASTRATGIPARFSGSGSGTEFTLTISSLQSEDFAVYYCQQYNNWPPWTFGQGTKVEIKRT

SEQ ID NO: 113 - protein, 115 aa, Artificial Sequence
  Description of Artificial Sequence: Synthetic polypeptide
  A17_IGKJ1*01
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPWTFGQGTKVEIKRT

SEQ ID NO: 114 - protein, 110 aa, Artificial Sequence
  Description of Artificial Sequence: Synthetic polypeptide
  L5_IGKJ1*01
DIQMTQSPSSVSASVGDRVTITCRASQGISSWLAWYQQKPGKAPKLLIYAASSLQSGVPSRFSGSGSGTDFTLTISSLQPEDFATYYCQQANSFPPWTFGQGTKVEIKRT

SEQ ID NO: 115 - protein, 110 aa, Artificial Sequence
  Description of Artificial Sequence: Synthetic polypeptide
  L12_IGKJ1*01
DIQMTQSPSTLSASVGDRVTITCRASQSISSWLAWYQQKPGKAPKLLIYDASSLESGVPSRFSGSGSGTEFTLTISSLQPDDFATYYCQQYNSYSPWTFGQGTKVEIKRT

SEQ ID NO: 116 - protein, 116 aa, Artificial Sequence
  Description of Artificial Sequence: Synthetic polypeptide
  O1_IGKJ1*01
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPSWTFGQGTKVEIKRT

SEQ ID NO: 117 - protein, 111 aa, Artificial Sequence
  Description of Artificial Sequence: Synthetic polypeptide
  V1-4_IGLJ4*01
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFVFGGGTQLIIL

SEQ ID NO: 118 - protein, 116 aa, Artificial Sequence
  Description of Artificial Sequence: Synthetic polypeptide
  V4-6_IGLJ4*01
RPVLTQPPSLSASPGATARLPCTLSSDLSVGGKNMFWYQQKPGSSPRLFLYHYSDSDKQLGPGVPSRVSGSKETSSNTAFLLISGLQPEDEADYYCQVYESSANFVFGGGTQLIIL

SEQ ID NO: 119 - protein, 110 aa, Artificial Sequence
  Description of Artificial Sequence: Synthetic polypeptide
  O12_IGKJ1*01
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIKRT

SEQ ID NO: 120 - protein, 111 aa, Artificial Sequence
  Description of Artificial Sequence: Synthetic polypeptide
  L25_IGKJ1*01
EIVMTQSPATLSLSPGERATLSCRASQSVSSSYLSWYQQKPGQAPRLLIYGASTRATGIPARFSGSGSGTDFTLTISSLQPEDFAVYYCQQDYNLPPWTFGQGTKVEIKRT

SEQ ID NO: 121 - protein, 124 aa, Artificial Sequence
  Description of Artificial Sequence: Synthetic polypeptide
  VH1-46_IGHD6-6*01_IGHJ1*01 S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSFSAEYFQHWGQGTLVTVSSAS

SEQ ID NO: 122 - protein, 124 aa, Artificial Sequence
  Description of Artificial Sequence: Synthetic polypeptide
  VH1-46_IGHD6-6*01_IGHJ1*01 S104A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSASAEYFQHWGQGTLVTVSSAS

SEQ ID NO: 123 - protein, 124 aa, Artificial Sequence
  Description of Artificial Sequence: Synthetic polypeptide
  VH1-46_IGHD6-6*01_IGHJ1*01 S103P
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSPSSAEYFQHWGQGTLVTVSSAS

SEQ ID NO: 124 - protein, 124 aa, Artificial Sequence
  Description of Artificial Sequence: Synthetic polypeptide
  VH1-46_IGHD6-6*01_IGHJ1*01 S102A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYASSSAEYFQHWGQGTLVTVSSAS

SEQ ID NO: 125 - protein, 124 aa, Artificial Sequence
  Description of Artificial Sequence: Synthetic polypeptide
  VH1-46_IGHD6-6*01_IGHJ1*01 S102A/S103P/S104F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQHWGQGTLVTVSSAS

SEQ ID NO: 126 - protein, 124 aa, Artificial Sequence
  Description of Artificial Sequence: Synthetic polypeptide
  VH1-46_IGHD6-6*01_IGHJ1*01 S102A/S103P/S104F/H111F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 127 - protein, 124 aa, Artificial Sequence
  Description of Artificial Sequence: Synthetic polypeptide
  VH1-46_IGHD6-6*01_IGHJ1*01 S102A/S103P/S104F/H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQYWGQGTLVTVSSAS

SEQ ID NO: 128 - protein, 124 aa, Artificial Sequence
  Description of Artificial Sequence: Synthetic polypeptide
  VH1-46_IGHD6-6*01_IGHJ1*01 S102A/S103P/S104Y/H111Y
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPYSAEYFQYWGQGTLVTVSSAS

SEQ ID NO: 129 - protein, 124 aa, Artificial Sequence
  Description of Artificial Sequence: Synthetic polypeptide
  VH1-46_IGHD6-6*01_IGHJ1*01 E100A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREAYSSSSAEYFQHWGQGTLVTVSSAS

SEQ ID NO: 130 - protein, 124 aa, Artificial Sequence
  Description of Artificial Sequence: Synthetic polypeptide
  VH1-46_IGHD6-6*01_IGHJ1*01 Y101A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEASSSSAEYFQHWGQGTLVTVSSAS

SEQ ID NO: 131 - protein, 124 aa, Artificial Sequence
  Description of Artificial Sequence: Synthetic polypeptide
  VH1-46_IGHD6-6*01_IGHJ1*01 S103A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSASSAEYFQHWGQGTLVTVSSAS

SEQ ID NO: 132 - protein, 124 aa, Artificial Sequence
  Description of Artificial Sequence: Synthetic polypeptide
  VH1-46_IGHD6-6*01_IGHJ1*01 S105A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSAAEYFQHWGQGTLVTVSSAS

SEQ ID NO: 133 - protein, 124 aa, Artificial Sequence
  Description of Artificial Sequence: Synthetic polypeptide
  VH1-46_IGHD6-6*01_IGHJ1*01 E107A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAAYFQHWGQGTLVTVSSAS

SEQ ID NO: 134 - protein, 124 aa, Artificial Sequence
  Description of Artificial Sequence: Synthetic polypeptide
  VH1-46_IGHD6-6*01_IGHJ1*01 Q110A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFAHWGQGTLVTVSSAS

SEQ ID NO: 135 - protein, 124 aa, Artificial Sequence
  Description of Artificial Sequence: Synthetic polypeptide
  VH1-46_IGHD6-6*01_IGHJ1*01 H111A
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSAEYFQAWGQGTLVTVSSAS

SEQ ID NO: 136 - protein, 124 aa, Artificial Sequence
  Description of Artificial Sequence: Synthetic polypeptide
  VH1-46_IGHD6-6*01_IGHJ1*01 S102Q
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYQSSSAEYFQHWGQGTLVTVSSAS

SEQ ID NO: 137 - protein, 124 aa, Artificial Sequence
  Description of Artificial Sequence: Synthetic polypeptide
  VH1-46_IGHD6-6*01_IGHJ1*01 S102V
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYVSSSAEYFQHWGQGTLVTVSSAS

SEQ ID NO: 138 - protein, 124 aa, Artificial Sequence
  Description of Artificial Sequence: Synthetic polypeptide
  VH1-46_IGHD6-6*01_IGHJ1*01 S102I
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYISSSAEYFQHWGQGTLVTVSSAS

SEQ ID NO: 139 - protein, 124 aa, Artificial Sequence
  Description of Artificial Sequence: Synthetic polypeptide
  VH1-46_IGHD6-6*01_IGHJ1*01 S102G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYGSSSAEYFQHWGQGTLVTVSSAS

SEQ ID NO: 140 - protein, 124 aa, Artificial Sequence
  Description of Artificial Sequence: Synthetic polypeptide
  VH1-46_IGHD6-6*01_IGHJ1*01 S103L
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSLSSAEYFQHWGQGTLVTVSSAS

SEQ ID NO: 141 - protein, 124 aa, Artificial Sequence
  Description of Artificial Sequence: Synthetic polypeptide
  VH1-46_IGHD6-6*01_IGHJ1*01 S103W
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSWSSAEYFQHWGQGTLVTVSSAS

SEQ ID NO: 142 - protein, 124 aa, Artificial Sequence
  Description of Artificial Sequence: Synthetic polypeptide
  VH1-46_IGHD6-6*01_IGHJ1*01 S103F
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSFSSAEYFQHWGQGTLVTVSSAS

SEQ ID NO: 143 - protein, 124 aa, Artificial Sequence
  Description of Artificial Sequence: Synthetic polypeptide
  VH1-46_IGHD6-6*01_IGHJ1*01 S103N
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSNSSAEYFQHWGQGTLVTVSSAS

SEQ ID NO: 144 - protein, 124 aa, Artificial Sequence
  Description of Artificial Sequence: Synthetic polypeptide
  VH1-46_IGHD6-6*01_IGHJ1*01 S103H
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSHSSAEYFQHWGQGTLVTVSSAS

SEQ ID NO: 145 - protein, 124 aa, Artificial Sequence
  Description of Artificial Sequence: Synthetic polypeptide
  VH1-46_IGHD6-6*01_IGHJ1*01 S103C
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSCSSAEYFQHWGQGTLVTVSSAS

SEQ ID NO: 146 - protein, 124 aa, Artificial Sequence
  Description of Artificial Sequence: Synthetic polypeptide
  VH1-46_IGHD6-6*01_IGHJ1*01 S103G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSGSSAEYFQHWGQGTLVTVSSAS

SEQ ID NO: 147 - protein, 124 aa, Artificial Sequence
  Description of Artificial Sequence: Synthetic polypeptide
  VH1-46_IGHD6-6*01_IGHJ1*01 S104C
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSGSAEYFQHWGQGTLVTVSSAS

SEQ ID NO: 148 - protein, 124 aa, Artificial Sequence
  Description of Artificial Sequence: Synthetic polypeptide
  VH1-46_IGHD6-6*01_IGHJ1*01 S104G
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSCSAEYFQHWGQGTLVTVSSAS

SEQ ID NO: 149 - protein, 124 aa, Artificial Sequence
  Description of Artificial Sequence: Synthetic polypeptide
  VH1-46_IGHD6-6*01_IGHJ1*01 S104H
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSHSAEYFQHWGQGTLVTVSSAS

SEQ ID NO: 150 - protein, 124 aa, Artificial Sequence
  Description of Artificial Sequence: Synthetic polypeptide
  VH1-46_IGHD6-6*01_IGHJ1*01 S104L
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSLSAEYFQHWGQGTLVTVSSAS

SEQ ID NO: 151 - protein, 124 aa, Artificial Sequence
  Description of Artificial Sequence: Synthetic polypeptide
  VH1-46_IGHD6-6*01_IGHJ1*01 S104R
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSRSAEYFQHWGQGTLVTVSSAS

SEQ ID NO: 152 - protein, 124 aa, Artificial Sequence
  Description of Artificial Sequence: Synthetic polypeptide
  VH1-46_IGHD6-6*01_IGHJ1*01 S102A/S103P/S104F G55W
QVQLVQSGAEVKKPGASVKVSCKASGYTFTSYYMHWVRQAPGQGLEWMGIINPSWGSTSYAQKFQGRVTMTRDTSTSTVYMELSSLRSEDTAVYYCAREEYAPFSAEYFQHWGQGTLVTVSSAS

SEQ ID NO: 153 - protein, 124 aa, Artificial Sequence
  Description of Artificial Sequence: Synthetic polypeptide
  VH1-46_IGHD6-6*01_IGHJ1*01 S102A/S103P/S104F G55D
QVQLVQSGAEVKKPGASVKVSCKASGYTFTSYYMHWVRQAPGQGLEWMGIINPSDGSTSYAQKFQGRVTMTRDTSTSTVYMELSSLRSEDTAVYYCAREEYAPFSAEYFQHWGQGTLVTVSSAS

SEQ ID NO: 154 - protein, 124 aa, Artificial Sequence
  Description of Artificial Sequence: Synthetic polypeptide
  VH1-46_IGHD6-6*01_IGHJ1*01 S102A/S103P/S104F A106E
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSEEYFQHWGQGTLVTVSSAS

SEQ ID NO: 155 - protein, 124 aa, Artificial Sequence
  Description of Artificial Sequence: Synthetic polypeptide
  VH1-46_IGHD6-6*01_IGHJ1*01 S102A/S103P/S104F H111S
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQSWGQGTLVTVSSAS

SEQ ID NO: 156 - protein, 124 aa, Artificial Sequence
  Description of Artificial Sequence: Synthetic polypeptide
  VH1-46_IGHD6-6*01_IGHJ1*01 S102A/S103P/S104F/H111F T28A
QVQLVQSGAEVKKPGASVKVSCKASGYAFTSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 157 - protein, 124 aa, Artificial Sequence
  Description of Artificial Sequence: Synthetic polypeptide
  VH1-46_IGHD6-6*01_IGHJ1*01 S102A/S103P/S104F/H111F F29A
QVQLVQSGAEVKKPGASVKVSCKASGYTATSYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 158 - protein, 124 aa, Artificial Sequence
  Description of Artificial Sequence: Synthetic polypeptide
  VH1-46_IGHD6-6*01_IGHJ1*01 S102A/S103P/S104F/H111F T30A
QVQLVQSGAEVKKPGASVKVSCKASGYTFASYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 159 - protein, 124 aa, Artificial Sequence
  Description of Artificial Sequence: Synthetic polypeptide
  VH1-46_IGHD6-6*01_IGHJ1*01 S102A/S103P/S104F/H111F S31A
QVQLVQSGAEVKKPGASVKVSCKASGYTFTAYYMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 160 - protein, 124 aa, Artificial Sequence
  Description of Artificial Sequence: Synthetic polypeptide
  VH1-46_IGHD6-6*01_IGHJ1*01 S102A/S103P/S104F/H111F Y33A
QVQLVQSGAEVKKPGASVKVSCKASGYTFTSYAMHWVRQAPGQGLEWMGIINPSGGSTSYAQKFQGRVTMTRDTSTSTVYMELSSLRSEDTAVYYCAREEYAPFSAEYFQFWGQGTLVTVSSAS

SEQ ID NO: 161 - protein, 124 aa, Artificial Sequence
  Description of Artificial Sequence: Synthetic polypeptide
  VH1-46_IGHD6-6*01_IGHJ1*01 S102A/S103P/S104F/H111F I50A
QVQLVQSGAEVKKPGASVKVSCKASGYTFTSYYMHWVRQAPGQGLEWMGAINPSGGSTSYAQKFQGRVTMTRDTSTSTVYMELSSLRSEDTAVYYCAREEYAPFSAEYFQFWGQGTLVTVSSAS

SEQ ID NO: 162 - protein, 124 aa, Artificial Sequence
  Description of Artificial Sequence: Synthetic polypeptide
  VH1-46_IGHD6-6*01_IGHJ1*01 S102A/S103P/S104F/H111F I51A
QVQLVQSGAEVKKPGASVKVSCKASGYTFTSYYMHWVRQAPGQGLEWMGIANPSGGSTSYAQKFQGRVTMTRDTSTSTVYMELSSLRSEDTAVYYCAREEYAPFSAEYFQFWGQGTLVTVSSAS

SEQ ID NO: 163 - protein, 124 aa, Artificial Sequence
  Description of Artificial Sequence: Synthetic polypeptide
  VH1-46_IGHD6-6*01_IGHJ1*01 S102A/S103P/S104F/H111F N52A
QVQLVQSGAEVKKPGASVKVSCKASGYTFTSYYMHWVRQAPGQGLEWMGIIAPSGGSTSYAQKFQGRVTMTRDTSTSTVYMELSSLRSEDTAVYYCAREEYAPFSAEYFQFWGQGTLVTVSSAS

SEQ ID NO: 164 - protein, 124 aa, Artificial Sequence
  Description of Artificial Sequence: Synthetic polypeptide
  VH1-46_IGHD6-6*01_IGHJ1*01 S102A/S103P/S104F/H111F P53A
QVQLVQSGAEVKKPGASVKVSCKASGYTFTSYYMHWVRQAPGQGLEWMGIINASGGSTSYAQKFQGRVTMTRDTSTSTVYMELSSLRSEDTAVYYCAREEYAPFSAEYFQFWGQGTLVTVSSAS

SEQ ID NO: 165 - protein, 124 aa, Artificial Sequence
  Description of Artificial Sequence: Synthetic polypeptide
  VH1-46_IGHD6-6*01_IGHJ1*01 S102A/S103P/S104F/H111F S54A
QVQLVQSGAEVKKPGASVKVSCKASGYTFTSYYMHWVRQAPGQGLEWMGIINPAGGSTSYAQKFQGRVTMTRDTSTSTVYMELSSLRSEDTAVYYCAREEYAPFSAEYFQFWGQGTLVTVSSAS

SEQ ID NO: 166 - protein, 124 aa, Artificial Sequence
  Description of Artificial Sequence: Synthetic polypeptide
  VH1-46_IGHD6-6*01_IGHJ1*01 S102A/S103P/S104F/H111F G55A
QVQLVQSGAEVKKPGASVKVSCKASGYTFTSYYMHWVRQAPGQGLEWMGIINPSAGSTSYAQKFQGRVTMTRDTSTSTVYMELSSLRSEDTAVYYCAREEYAPFSAEYFQFWGQGTLVTVSSAS

SEQ ID NO: 167 - protein, 124 aa, Artificial Sequence
  Description of Artificial Sequence: Synthetic polypeptide
  VH1-46_IGHD6-6*01_IGHJ1*01 S102A/S103P/S104F/H111F G56A
QVQLVQSGAEVKKPGASVKVSCKASGYTFTSYYMHWVRQAPGQGLEWMGIINPSGASTSYAQKFQGRVTMTRDTSTSTVYMELSSLRSEDTAVYYCAREEYAPFSAEYFQFWGQGTLVTVSSAS

SEQ ID NO: 168 - protein, 124 aa, Artificial Sequence
  Description of Artificial Sequence: Synthetic polypeptide
  VH1-46_IGHD6-6*01_IGHJ1*01 S102A/S103P/S104F/H111F S57A
QVQLVQSGAEVKKPGASVKVSCKASGYTFTSYYMHWVRQAPGQGLEWMGIINPSGGATSYAQKFQGRVTMTRDTSTSTVYMELSSLRSEDTAVYYCAREEYAPFSAEYFQFWGQGTLVTVSSAS

SEQ ID NO: 169 - protein, 124 aa, Artificial Sequence
  Description of Artificial Sequence: Synthetic polypeptide
  VH1-46_IGHD6-6*01_IGHJ1*01 S102A/S103P/S104F/H111F T58A
QVQLVQSGAEVKKPGASVKVSCKASGYTFTSYYMHWVRQAPGQGLEWMGIINPSGGSASYAQKFQGRVTMTRDTSTSTVYMELSSLRSEDTAVYYCAREEYAPFSAEYFQFWGQGTLVTVSSAS

SEQ ID NO: 170 - protein, 124 aa, Artificial Sequence
  Description of Artificial Sequence: Synthetic polypeptide
  VH1-46_IGHD6-6*01_IGHJ1*01 S102A/S103P/S104F/H111F S59A
QVQLVQSGAEVKKPGASVKVSCKASGYTFTSYYMHWVRQAPGQGLEWMGIINPSGGSTAYAQKFQGRVTMTRDTSTSTVYMELSSLRSEDTAVYYCAREEYAPFSAEYFQFWGQGTLVTVSSAS

SEQ ID NO: 171 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52V
QVQLVQSGAEVKKPGASVKVSCKASGYTFTSYYMHWVRQAPGQGLEWMGITVPSGGSTSYAQKFQGRVTMTRDTSTSTVYMELSSLRSEDTAVYYCAREEYAPFSAEYFQFWGQGTLVTVSSAS

SEQ ID NO: 172 - protein, 124 aa, Artificial Sequence
  Description of Artificial Sequence: Synthetic polypeptide
  VH1-46_IGHD6-6*01_IGHJ1*01 S102A/S103P/S104F/H111F N52G
QVQLVQSGAEVKKPGASVKVSCKASGYTFTSYYMHWVRQAPGQGLEWMGIIGPSGGSTSYAQKFQGRVTMTRDTSTSTVYMELSSLRSEDTAVYYCAREEYAPFSAEYFQFWGQGTLVTVSSAS

SEQ ID NO: 173 - protein, 124 aa, Artificial Sequence
  Description of Artificial Sequence: Synthetic polypeptide
  VH1-46_IGHD6-6*01_IGHJ1*01 S102A/S103P/S104F/H111F N52T
QVQLVQSGAEVKKPGASVKVSCKASGYTFTSYYMHWVRQAPGQGLEWMGIITPSGGSTSYAQKFQGRVTMTRDTSTSTVYMELSSLRSEDTAVYYCAREEYAPFSAEYFQFWGQGTLVTVSSAS

SEQ ID NO: 174 - protein, 124 aa, Artificial Sequence
  Description of Artificial Sequence: Synthetic polypeptide
  VH1-46_IGHD6-6*01_IGHJ1*01 S102A/S103P/S104F/H111F N52P
QVQLVQSGAEVKKPGASVKVSCKASGYTFTSYYMHWVRQAPGQGLEWMGIIPPSGGSTSYAQKFQGRVTMTRDTSTSTVYMELSSLRSEDTAVYYCAREEYAPFSAEYFQFWGQGTLVTVSSAS

SEQ ID NO: 175 - protein, 124 aa, Artificial Sequence
  Description of Artificial Sequence: Synthetic polypeptide
  VH1-46_IGHD6-6*01_IGHJ1*01 S102A/S103P/S104F/H111F N52L
QVQLVQSGAEVKKPGASVKVSCKASGYTFTSYYMHWVRQAPGQGLEWMGIILPSGGSTSYAQKFQGRVTMTRDTSTSTVYMELSSLRSEDTAVYYCAREEYAPFSAEYFQFWGQGTLVTVSSAS

SEQ ID NO: 176 - protein, 124 aa, Artificial Sequence
  Description of Artificial Sequence: Synthetic polypeptide
  VH1-46_IGHD6-6*01_IGHJ1*01 S102A/S103P/S104F/H111F N52W
QVQLVQSGAEVKKPGASVKVSCKASGYTFTSYYMHWVRQAPGQGLEWMGIIWPSGGSTSYAQKFQGRVTMTRDTSTSTVYMELSSLRSEDTAVYYCAREEYAPFSAEYFQFWGQGTLVTVSSAS

SEQ ID NO: 177 - protein, 124 aa, Artificial Sequence
  Description of Artificial Sequence: Synthetic polypeptide
  VH1-46_IGHD6-6*01_IGHJ1*01 S102A/S103P/S104F/H111F N52Y
QVQLVQSGAEVKKPGASVKVSCKASGYTFTSYYMHWVRQAPGQGLEWMGIIYPSGGSTSYAQKFQGRVTMTRDTSTSTVYMELSSLRSEDTAVYYCAREEYAPFSAEYFQFWGQGTLVTVSSAS

SEQ ID NO: 178 - protein, 124 aa, Artificial Sequence
  Description of Artificial Sequence: Synthetic polypeptide
  VH1-46_IGHD6-6*01_IGHJ1*01 S102A/S103P/S104F/H111F N52V
QVQLVQSGAEVKKPGASVKVSCKASGYTFTSYYMHWVRQAPGQGLEWMGIIVPSGGSTSYAQKFQGRVTMTRDTSTSTVYMELSSLRSEDTAVYYCAREEYAPFSAEYFQFWGQGTLVTVSSAS

SEQ ID NO: 179 - protein, 124 aa, Artificial Sequence
  Description of Artificial Sequence: Synthetic polypeptide
  VH1-46_IGHD6-6*01_IGHJ1*01 S102A/S103P/S104F/H111F N52S
QVQLVQSGAEVKKPGASVKVSCKASGYTFTSYYMHWVRQAPGQGLEWMGIISPSGGSTSYAQKFQGRVTMTRDTSTSTVYMELSSLRSEDTAVYYCAREEYAPFSAEYFQFWGQGTLVTVSSAS

SEQ ID NO: 180 - protein, 124 aa, Artificial Sequence
  Description of Artificial Sequence: Synthetic polypeptide
  VH1-46_IGHD6-6*01_IGHJ1*01 S102A/S103P/S104F/H111F N52Q
QVQLVQSGAEVKKPGASVKVSCKASGYTFTSYYMHWVRQAPGQGLEWMGIIQPSGGSTSYAQKFQGRVTMTRDTSTSTVYMELSSLRSEDTAVYYCAREEYAPFSAEYFQFWGQGTLVTVSSAS

SEQ ID NO: 181 - protein, 124 aa, Artificial Sequence
  Description of Artificial Sequence: Synthetic polypeptide
  VH1-46_IGHD6-6*01_IGHJ1*01 S102A/S103P/S104F/H111F N52K
QVQLVQSGAEVKKPGASVKVSCKASGYTFTSYYMHWVRQAPGQGLEWMGIIKPSGGSTSYAQKFQGRVTMTRDTSTSTVYMELSSLRSEDTAVYYCAREEYAPFSAEYFQFWGQGTLVTVSSAS

SEQ ID NO: 182 - protein, 124 aa, Artificial Sequence
  Description of Artificial Sequence: Synthetic polypeptide
  VH1-46_IGHD6-6*01_IGHJ1*01 S102A/S103P/S104F/H111F G56V
QVQLVQSGAEVKKPGASVKVSCKASGYTFTSYYMHWVRQAPGQGLEWMGIINPSGVSTSYAQKFQGRVTMTRDTSTSTVYMELSSLRSEDTAVYYCAREEYAPFSAEYFQFWGQGTLVTVSSAS

SEQ ID NO: 183 - protein, 124 aa, Artificial Sequence
  Description of Artificial Sequence: Synthetic polypeptide
  VH1-46_IGHD6-6*01_IGHJ1*01 S102A/S103P/S104F/H111F N52R
QVQLVQSGAEVKKPGASVKVSCKASGYTFTSYYMHWVRQAPGQGLEWMGIIRPSGGSTSYAQKFQGRVTMTRDTSTSTVYMELSSLRSEDTAVYYCAREEYAPFSAEYFQFWGQGTLVTVSSAS

SEQ ID NO: 184 - protein, 124 aa, Artificial Sequence
  Description of Artificial Sequence: Synthetic polypeptide
  VH1-46_IGHD6-6*01_IGHJ1*01 S102A/S103P/S104F/H111F G56S
QVQLVQSGAEVKKPGASVKVSCKASGYTFTSYYMHWVRQAPGQGLEWMGIINPSGSSTSYAQKFQGRVTMTRDTSTSTVYMELSSLRSEDTAVYYCAREEYAPFSAEYFQFWGQGTLVTVSSAS

SEQ ID NO: 185 - protein, 124 aa, Artificial Sequence
  Description of Artificial Sequence: Synthetic polypeptide
  VH1-46_IGHD6-6*01_IGHJ1*01 S102A/S103P/S104F/H111F G56K
QVQLVQSGAEVKKPGASVKVSCKASGYTFTSYYMHWVRQAPGQGLEWMGIINPSGKSTSYAQKFQGRVTMTRDTSTSTVYMELSSLRSEDTAVYYCAREEYAPFSAEYFQFWGQGTLVTVSSAS

SEQ ID NO: 186 - protein, 124 aa, Artificial Sequence
  Description of Artificial Sequence: Synthetic polypeptide
  VH1-46_IGHD6-6*01_IGHJ1*01 S102A/S103P/S104F/H111F G56T
QVQLVQSGAEVKKPGASVKVSCKASGYTFTSYYMHWVRQAPGQGLEWMGIINPSGTSTSYAQKFQGRVTMTRDTSTSTVYMELSSLRSEDTAVYYCAREEYAPFSAEYFQFWGQGTLVTVSSAS

SEQ ID NO: 187 - protein, 124 aa, Artificial Sequence
  Description of Artificial Sequence: Synthetic polypeptide
  VH1-46_IGHD6-6*01_IGHJ1*01 S102A/S103P/S104F/H111F G56L
QVQLVQSGAEVKKPGASVKVSCKASGYTFTSYYMHWVRQAPGQGLEWMGIINPSGLSTSYAQKFQGRVTMTRDTSTSTVYMELSSLRSEDTAVYYCAREEYAPFSAEYFQFWGQGTLVTVSSAS

SEQ ID NO: 188 - protein, 124 aa, Artificial Sequence
  Description of Artificial Sequence: Synthetic polypeptide
  VH1-46_IGHD6-6*01_IGHJ1*01 S102A/S103P/S104F/H111F G56R
QVQLVQSGAEVKKPGASVKVSCKASGYTFTSYYMHWVRQAPGQGLEWMGIINPSGRSTSYAQKFQGRVTMTRDTSTSTVYMELSSLRSEDTAVYYCAREEYAPFSAEYFQFWGQGTLVTVSSAS

SEQ ID NO: 189 - protein, 124 aa, Artificial Sequence
  Description of Artificial Sequence: Synthetic polypeptide
  VH1-46_IGHD6-6*01_IGHJ1*01 S102A/S103P/S104F/H111F G56H
QVQLVQSGAEVKKPGASVKVSCKASGYTFTSYYMHWVRQAPGQGLEWMGIINPSGHSTSYAQKFQGRVTMTRDTSTSTVYMELSSLRSEDTAVYYCAREEYAPFSAEYFQFWGQGTLVTVSSAS

SEQ ID NO: 190 - protein, 124 aa, Artificial Sequence
  Description of Artificial Sequence: Synthetic polypeptide
  VH1-46_IGHD6-6*01_IGHJ1*01 S102A/S103P/S104F/H111F G56I
QVQLVQSGAEVKKPGASVKVSCKASGYTFTSYYMHWVRQAPGQGLEWMGIINPSGISTSYAQKFQGRVTMTRDTSTSTVYMELSSLRSEDTAVYYCAREEYAPFSAEYFQFWGQGTLVTVSSAS

SEQ ID NO: 191 - protein, 124 aa, Artificial Sequence
  Description of Artificial Sequence: Synthetic polypeptide
  VH1-46_IGHD6-6*01_IGHJ1*01 S102A/S103P/S104F/H111F G56W
QVQLVQSGAEVKKPGASVKVSCKASGYTFTSYYMHWVRQAPGQGLEWMGIINPSGWSTSYAQKFQGRVTMTRDTSTSTVYMELSSLRSEDTAVYYCAREEYAPFSAEYFQFWGQGTLVTVSSAS

SEQ ID NO: 192 - protein, 124 aa, Artificial Sequence
  Description of Artificial Sequence: Synthetic polypeptide
  VH1-46_IGHD6-6*01_IGHJ1*01 S102A/S103P/S104F/H111F S54I
QVQLVQSGAEVKKPGASVKVSCKASGYTFTSYYMHWVRQAPGQGLEWMGIINPIGGSTSYAQKFQGRVTMTRDTSTSTVYMELSSLRSEDTAVYYCAREEYAPFSAEYFQFWGQGTLVTVSSAS

SEQ ID NO: 193 - protein, 124 aa, Artificial Sequence
  Description of Artificial Sequence: Synthetic polypeptide
  VH1-46_IGHD6-6*01_IGHJ1*01 S102A/S103P/S104F/H111F S54E
QVQLVQSGAEVKKPGASVKVSCKASGYTFTSYYMHWVRQAPGQGLEWMGIINPEGGSTSYAQKFQGRVTMTRDTSTSTVYMELSSLRSEDTAVYYCAREEYAPFSAEYFQFWGQGTLVTVSSAS

SEQ ID NO: 194 - protein, 124 aa, Artificial Sequence
  Description of Artificial Sequence: Synthetic polypeptide
  VH1-46_IGHD6-6*01_IGHJ1*01 S102A/S103P/S104F/H111F S54R
QVQLVQSGAEVKKPGASVKVSCKASGYTFTSYYMHWVRQAPGQGLEWMGIINPRGGSTSYAQKFQGRVTMTRDTSTSTVYMELSSLRSEDTAVYYCAREEYAPFSAEYFQFWGQGTLVTVSSAS

SEQ ID NO: 195 - protein, 124 aa, Artificial Sequence
  Description of Artificial Sequence: Synthetic polypeptide
  VH1-46_IGHD6-6*01_IGHJ1*01 S102A/S103P/S104F/H111F S54G
QVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCAREEYAPFSAEYFQFWGQGTLVTVSSAS

SEQ ID NO: 196 - protein, 124 aa, Artificial Sequence
  Description of Artificial Sequence: Synthetic polypeptide
  VH1-46_IGHD6-6*01_IGHJ1*01 S102A/S103P/S104F/H111F S54T
QVQLVQSGAEVKKPGASVKVSCKASGYTFTSYYMHWVRQAPGQGLEWMGIINPTGGSTSYAQKFQGRVTMTRDTSTSTVYMELSSLRSEDTAVYYCAREEYAPFSAEYFQFWGQGTLVTVSSAS

SEQ ID NO: 197 - protein, 124 aa, Artificial Sequence
  Description of Artificial Sequence: Synthetic polypeptide
  VH1-46_IGHD6-6*01_IGHJ1*01 S102A/S103P/S104F/H111F S54L
QVQLVQSGAEVKKPGASVKVSCKASGYTFTSYYMHWVRQAPGQGLEWMGIINPLGGSTSYAQKFQGRVTMTRDTSTSTVYMELSSLRSEDTAVYYCAREEYAPFSAEYFQFWGQGTLVTVSSAS

SEQ ID NO: 198 - protein, 124 aa, Artificial Sequence
  Description of Artificial Sequence: Synthetic polypeptide
  VH1-46_IGHD6-6*01_IGHJ1*01 S102A/S103P/S104F/H111F S54V
QVQLVQSGAEVKKPGASVKVSCKASGYTFTSYYMHWVRQAPGQGLEWMGIINPVGGSTSYAQKFQGRVTMTRDTSTSTVYMELSSLRSEDTAVYYCAREEYAPFSAEYFQFWGQGTLVTVSSAS

SEQ ID NO: 199 - protein, 124 aa, Artificial Sequence
  Description of Artificial Sequence: Synthetic polypeptide
  VH1-46_IGHD6-6*01_IGHJ1*01 S102A/S103P/S104F/H111F S54N
QVQLVQSGAEVKKPGASVKVSCKASGYTFTSYYMHWVRQAPGQGLEWMGIINPNGGSTSYAQKFQGRVTMTRDTSTSTVYMELSSLRSEDTAVYYCAREEYAPFSAEYFQFWGQGTLVTVSSAS

SEQ ID NO: 200 - protein, 124 aa, Artificial Sequence
  Description of Artificial Sequence: Synthetic polypeptide
  VH1-46_IGHD6-6*01_IGHJ1*01 S102A/S103P/S104F/H111F S54P
QVQLVQSGAEVKKPGASVKVSCKASGYTFTSYYMHWVRQAPGQGLEWMGIINPPGGSTSYAQKFQGRVTMTRDTSTSTVYMELSSLRSEDTAVYYCAREEYAPFSAEYFQFWGQGTLVTVSSAS

SEQ ID NO: 201 - protein, 124 aa, Artificial Sequence
  Description of Artificial Sequence: Synthetic polypeptide
  VH1-46_IGHD6-6*01_IGHJ1*01 S102A/S103P/S104F/H111F I50T/S54P
QVQLVQSGAEVKKPGASVKVSCKASGYTFTSYYMHWVRQAPGQGLEWMGTINPPGGSTSYAQKFQGRVTMTRDTSTSTVYMELSSLRSEDTAVYYCAREEYAPFSAEYFQFWGQGTLVTVSSAS

SEQ ID NO: 202 - protein, 124 aa, Artificial Sequence
  Description of Artificial Sequence: Synthetic polypeptide
  VH1-46_IGHD6-6*01_IGHJ1*01 S102A/S103P/S104F/H111F S54A/S59N
QVQLVQSGAEVKKPGASVKVSCKASGYTFTSYYMHWVRQAPGQGLEWMGIINPAGGSTNYAQKFQGRVTMTRDTSTSTVYMELSSLRSEDTAVYYCAREEYAPFSAEYFQFWGQGTLVTVSSAS

SEQ ID NO: 203 - protein, 124 aa, Artificial Sequence
  Description of Artificial Sequence: Synthetic polypeptide
  VH1-46_IGHD6-6*01_IGHJ1*01 S102A/S103P/S104F/H111F N52L/S54T/G56H
QVQLVQSGAEVKKPGASVKVSCKASGYTFTSYYMHWVRQAPGQGLEWMGIILPTGHSTSYAQKFQGRVTMTRDTSTSTVYMELSSLRSEDTAVYYCAREEYAPFSAEYFQFWGQGTLVTVSSAS

SEQ ID NO: 204 - protein, 124 aa, Artificial Sequence
  Description of Artificial Sequence: Synthetic polypeptide
  VH1-46_IGHD6-6*01_IGHJ1*01 S102A/S103P/S104F/H111F I51A/N52L/S54T/G56H
QVQLVQSGAEVKKPGASVKVSCKASGYTFTSYYMHWVRQAPGQGLEWMGIALPTGHSTSYAQKFQGRVTMTRDTSTSTVYMELSSLRSEDTAVYYCAREEYAPFSAEYFQFWGQGTLVTVSSAS

SEQ ID NO: 205 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/S54T/G56H
QVQLVQSGAEVKKPGASVKVSCKASGYTFTSYYMHWVRQAPGQGLEWMGITLPTGHSTSYAQKFQGRVTMTRDTSTSTVYMELSSLRSEDTAVYYCAREEYAPFSAEYFQFWGQGTLVTVSSAS

SEQ ID NO: 206 - protein, 124 aa, Artificial Sequence
  Description of Artificial Sequence: Synthetic polypeptide
  VH1-46_IGHD6-6*01_IGHJ1*01 S102A/S103P/S104F/H111F I51Y/N52L/S54T/G56H
QVQLVQSGAEVKKPGASVKVSCKASGYTFTSYYMHWVRQAPGQGLEWMGIYLPTGHSTSYAQKFQGRVTMTRDTSTSTVYMELSSLRSEDTAVYYCAREEYAPFSAEYFQFWGQGTLVTVSSAS

SEQ ID NO: 207 - protein, 124 aa, Artificial Sequence
  Description of Artificial Sequence: Synthetic polypeptide
  VH1-46_IGHD6-6*01_IGHJ1*01 S102A/S103P/S104F/H111F I51H/N52L/S54T/G56H
QVQLVQSGAEVKKPGASVKVSCKASGYTFTSYYMHWVRQAPGQGLEWMGIHLPTGHSTSYAQKFQGRVTMTRDTSTSTVYMELSSLRSEDTAVYYCAREEYAPFSAEYFQFWGQGTLVTVSSAS

SEQ ID NO: 208 - protein, 124 aa, Artificial Sequence
  Description of Artificial Sequence: Synthetic polypeptide
  VH1-46_IGHD6-6*01_IGHJ1*01 S102A/S103P/S104F/H111F I51E/N52L/S54T/G56H
QVQLVQSGAEVKKPGASVKVSCKASGYTFTSYYMHWVRQAPGQGLEWMGIELPTGHSTSYAQKFQGRVTMTRDTSTSTVYMELSSLRSEDTAVYYCAREEYAPFSAEYFQFWGQGTLVTVSSAS

SEQ ID NO: 209 - protein, 124 aa, Artificial Sequence
  Description of Artificial Sequence: Synthetic polypeptide
  VH1-46_IGHD6-6*01_IGHJ1*01 S102A/S103P/S104F/H111F I51G/N52L/S54T/G56H
QVQLVQSGAEVKKPGASVKVSCKASGYTFTSYYMHWVRQAPGQGLEWMGIGLPTGHSTSYAQKFQGRVTMTRDTSTSTVYMELSSLRSEDTAVYYCAREEYAPFSAEYFQFWGQGTLVTVSSAS

SEQ ID NO: 210 - protein, 124 aa, Artificial Sequence
  Description of Artificial Sequence: Synthetic polypeptide
  VH1-46_IGHD6-6*01_IGHJ1*01 S102A/S103P/S104F/H111F I51V/N52L/S54T/G56H
QVQLVQSGAEVKKPGASVKVSCKASGYTFTSYYMHWVRQAPGQGLEWMGIVLPTGHSTSYAQKFQGRVTMTRDTSTSTVYMELSSLRSEDTAVYYCAREEYAPFSAEYFQFWGQGTLVTVSSAS

SEQ ID NO: 211 - protein, 124 aa, Artificial Sequence
  Description of Artificial Sequence: Synthetic polypeptide
  VH1-46_IGHD6-6*01_IGHJ1*01 S102A/S103P/S104F/H111F I51S/N52L/S54T/G56H
QVQLVQSGAEVKKPGASVKVSCKASGYTFTSYYMHWVRQAPGQGLEWMGISLPTGHSTSYAQKFQGRVTMTRDTSTSTVYMELSSLRSEDTAVYYCAREEYAPFSAEYFQFWGQGTLVTVSSAS

SEQ ID NO: 212 - protein, 124 aa, Artificial Sequence
  Description of Artificial Sequence: Synthetic polypeptide
  VH1-46_IGHD6-6*01_IGHJ1*01 S102A/S103P/S104F/H111F I51W/N52L/S54T/G56H
QVQLVQSGAEVKKPGASVKVSCKASGYTFTSYYMHWVRQAPGQGLEWMGIWLPTGHSTSYAQKFQGRVTMTRDTSTSTVYMELSSLRSEDTAVYYCAREEYAPFSAEYFQFWGQGTLVTVSSAS

SEQ ID NO: 213 - protein, 124 aa, Artificial Sequence
  Description of Artificial Sequence: Synthetic polypeptide
  VH1-46_IGHD6-6*01_IGHJ1*01 S102A/S103P/S104F/H111F I51R/N52L/S54T/G56H
QVQLVQSGAEVKKPGASVKVSCKASGYTFTSYYMHWVRQAPGQGLEWMGIRLPTGHSTSYAQKFQGRVTMTRDTSTSTVYMELSSLRSEDTAVYYCAREEYAPFSAEYFQFWGQGTLVTVSSAS

SEQ ID NO: 214 - protein, 124 aa, Artificial Sequence
  Description of Artificial Sequence: Synthetic polypeptide
  VH1-46_IGHD6-6*01_IGHJ1*01 S102A/S103P/S104F/H111F I51N/N52L/S54T/G56H
QVQLVQSGAEVKKPGASVKVSCKASGYTFTSYYMHWVRQAPGQGLEWMGINLPTGHSTSYAQKFQGRVTMTRDTSTSTVYMELSSLRSEDTAVYYCAREEYAPFSAEYFQFWGQGTLVTVSSAS

SEQ ID NO: 215 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53V/S54T/G56H
QVQLVQSGAEVKKPGASVKVSCKASGYTFTSYYMHWVRQAPGQGLEWMGITLVTGHSTSYAQKFQGRVTMTRDTSTSTVYMELSSLRSEDTAVYYCAREEYAPFSAEYFQFWGQGTLVTVSSAS

SEQ ID NO: 216 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53G/S54T/G56H
QVQLVQSGAEVKKPGASVKVSCKASGYTFTSYYMHWVRQAPGQGLEWMGITLGTGHSTSYAQKFQGRVTMTRDTSTSTVYMELSSLRSEDTAVYYCAREEYAPFSAEYFQFWGQGTLVTVSSAS

SEQ ID NO: 217 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53S/S54T/G56H
QVQLVQSGAEVKKPGASVKVSCKASGYTFTSYYMHWVRQAPGQGLEWMGITLSTGHSTSYAQKFQGRVTMTRDTSTSTVYMELSSLRSEDTAVYYCAREEYAPFSAEYFQFWGQGTLVTVSSAS

SEQ ID NO: 218 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53W/S54T/G56H
QVQLVQSGAEVKKPGASVKVSCKASGYTFTSYYMHWVRQAPGQGLEWMGITLWTGHSTSYAQKFQGRVTMTRDTSTSTVYMELSSLRSEDTAVYYCAREEYAPFSAEYFQFWGQGTLVTVSSAS

SEQ ID NO: 219 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53R/S54T/G56H
QVQLVQSGAEVKKPGASVKVSCKASGYTFTSYYMHWVRQAPGQGLEWMGITLRTGHSTSYAQKFQGRVTMTRDTSTSTVYMELSSLRSEDTAVYYCAREEYAPFSAEYFQFWGQGTLVTVSSAS

SEQ ID NO: 220 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53N/S54T/G56H
QVQLVQSGAEVKKPGASVKVSCKASGYTFTSYYMHWVRQAPGQGLEWMGITLNTGHSTSYAQKFQGRVTMTRDTSTSTVYMELSSLRSEDTAVYYCAREEYAPFSAEYFQFWGQGTLVTVSSAS

SEQ ID NO: 221 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53A/S54T/G56H
QVQLVQSGAEVKKPGASVKVSCKASGYTFTSYYMHWVRQAPGQGLEWMGITLATGHSTSYAQKFQGRVTMTRDTSTSTVYMELSSLRSEDTAVYYCAREEYAPFSAEYFQFWGQGTLVTVSSAS

SEQ ID NO: 222 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53T/S54T/G56H
QVQLVQSGAEVKKPGASVKVSCKASGYTFTSYYMHWVRQAPGQGLEWMGITLTTGHSTSYAQKFQGRVTMTRDTSTSTVYMELSSLRSEDTAVYYCAREEYAPFSAEYFQFWGQGTLVTVSSAS

SEQ ID NO: 223 - protein, 124 aa, Artificial Sequence; identical to SEQ ID NO: 205
  Description of Artificial Sequence: Synthetic polypeptide
  VH1-46_IGHD6-6*01_IGHJ1*01 S102A/S103P/S104F/H111F I51T/N52L/P53Y/S54T/G56H

SEQ ID NO: 224 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53H/S54T/G56H
QVQLVQSGAEVKKPGASVKVSCKASGYTFTSYYMHWVRQAPGQGLEWMGITLHTGHSTSYAQKFQGRVTMTRDTSTSTVYMELSSLRSEDTAVYYCAREEYAPFSAEYFQFWGQGTLVTVSSAS

SEQ ID NO: 225 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53E/S54T/G56H
QVQLVQSGAEVKKPGASVKVSCKASGYTFTSYYMHWVRQAPGQGLEWMGITLETGHSTSYAQKFQGRVTMTRDTSTSTVYMELSSLRSEDTAVYYCAREEYAPFSAEYFQFWGQGTLVTVSSAS

SEQ ID NO: 226 - protein, 124 aa, Artificial Sequence
  Description of Artificial Sequence: Synthetic polypeptide
  VH1-46_IGHD6-6*01_IGHJ1*01 S102A/S103P/S104F/H111F I51T/N52L/P53M/S54T/G56H
QVQLVQSGAEVKKPGASVKVSCKASGYTFTSYYMHWVRQAPGQGLEWMGITLMTGHSTSYAQKFQGRVTMTRDTSTSTVYMELSSLRSEDTAVYYCAREEYAPFSAEYFQFWGQGTLVTVSSAS

SEQ ID NO: 227 - protein, 124 aa, Artificial Sequence
  Description of Artificial Sequence: Synthetic polypeptide
  VH1-46_IGHD6-6*01_IGHJ1*01 S102A/S103P/S104F/H111F S84G
QVQLVQSGAEVKKPGASVKVSCKASGYTFTSYYMHWVRQAPGQGLEWMGIINPSGGSTSYAQKFQGRVTMTRDTSTSTVYMELGSLRSEDTAVYYCAREEYAPFSAEYFQFWGQGTLVTVSSAS

SEQ ID NO: 228 - protein, 124 aa, Artificial Sequence
  Description of Artificial Sequence: Synthetic polypeptide
  VH1-46_IGHD6-6*01_IGHJ1*01 S102A/S103P/S104F/H111F S84Q
QVQLVQSGAEVKKPGASVKVSCKASGYTFTSYYMHWVRQAPGQGLEWMGIINPSGGSTSYAQKFQGRVTMTRDTSTSTVYMELQSLRSEDTAVYYCAREEYAPFSAEYFQFWGQGTLVTVSSAS

SEQ ID NO: 229 - protein, 124 aa, Artificial Sequence
  Description of Artificial Sequence: Synthetic polypeptide
  VH1-46_IGHD6-6*01_IGHJ1*01 S102A/S103P/S104F/H111F S84N
QVQLVQSGAEVKKPGASVKVSCKASGYTFTSYYMHWVRQAPGQGLEWMGIINPSGGSTSYAQKFQGRVTMTRDTSTSTVYMELNSLRSEDTAVYYCAREEYAPFSAEYFQFWGQGTLVTVSSAS

SEQ ID NO: 230 - protein, 124 aa, Artificial Sequence
  Description of Artificial Sequence: Synthetic polypeptide
  VH1-46_IGHD6-6*01_IGHJ1*01 S102A/S103P/S104F/H111F S84H
QVQLVQSGAEVKKPGASVKVSCKASGYTFTSYYMHWVRQAPGQGLEWMGIINPSGGSTSYAQKFQGRVTMTRDTSTSTVYMELHSLRSEDTAVYYCAREEYAPFSAEYFQFWGQGTLVTVSSAS

SEQ ID NO: 231 - protein, 124 aa, Artificial Sequence
  Description of Artificial Sequence: Synthetic polypeptide
  VH1-46_IGHD6-6*01_IGHJ1*01 S102A/S103P/S104F/H111F S84R
QVQLVQSGAEVKKPGASVKVSCKASGYTFTSYYMHWVRQAPGQGLEWMGIINPSGGSTSYAQKFQGRVTMTRDTSTSTVYMELRSLRSEDTAVYYCAREEYAPFSAEYFQFWGQGTLVTVSSAS

SEQ ID NO: 232 - protein, 124 aa, Artificial Sequence
  Description of Artificial Sequence: Synthetic polypeptide
  VH1-46_IGHD6-6*01_IGHJ1*01 S102A/S103P/S104F/H111F S84K
QVQLVQSGAEVKKPGASVKVSCKASGYTFTSYYMHWVRQAPGQGLEWMGIINPSGGSTSYAQKFQGRVTMTRDTSTSTVYMELKSLRSEDTAVYYCAREEYAPFSAEYFQFWGQGTLVTVSSAS

SEQ ID NO: 233 - protein, 124 aa, Artificial Sequence
  Description of Artificial Sequence: Synthetic polypeptide
  VH1-46_IGHD6-6*01_IGHJ1*01 S102A/S103P/S104F/H111F S84T
QVQLVQSGAEVKKPGASVKVSCKASGYTFTSYYMHWVRQAPGQGLEWMGIINPSGGSTSYAQKFQGRVTMTRDTSTSTVYMELTSLRSEDTAVYYCAREEYAPFSAEYFQFWGQGTLVTVSSAS

SEQ ID NO: 234 - protein, 102 aa, Artificial Sequence
  Description of Artificial Sequence: Synthetic polypeptide
  VH1-46_IGHD6-6*01_IGHJ1*01 S103STOP
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYS

SEQ ID NO: 235 - protein, 124 aa, Artificial Sequence
  Description of Artificial Sequence: Synthetic polypeptide
  VH1-46_IGHD6-6*01_IGHJ1*01 S102A/S103P/S104F G55X
  misc_feature (55)..(55): Xaa is an unknown amino acid residue
QVQLVQSGAEVKKPGASVKVSCKASGYTFTSYYMHWVRQAPGQGLEWMGIINPSXGSTSYAQKFQGRVTMTRDTSTSTVYMELSSLRSEDTAVYYCAREEYAPFSAEYFQHWGQGTLVTVSSAS

SEQ ID NO: 236 - protein, 124 aa, Artificial Sequence
  Description of Artificial Sequence: Synthetic polypeptide
  VH1-46_IGHD6-6*01_IGHJ1*01 S102A/S103P/S104F E100X
  misc_feature (100)..(100): Xaa is an unknown amino acid residue
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREXYAPFSAEYFQHWGQGTLVTVSSAS

SEQ ID NO: 237 - protein, 124 aa, Artificial Sequence
  Description of Artificial Sequence: Synthetic polypeptide
  VH1-46_IGHD6-6*01_IGHJ1*01 S102A/S103P/S104F A106X
  misc_feature (106)..(106): Xaa is an unknown amino acid residue
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSXEYFQHWGQGTLVTVSSAS

SEQ ID NO: 238 - protein, 124 aa, Artificial Sequence
  Description of Artificial Sequence: Synthetic polypeptide
  VH1-46_IGHD6-6*01_IGHJ1*01 S102A/S103P/S104F Y108X
  misc_feature (108)..(108): Xaa is an unknown amino acid residue
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEXFQHWGQGTLVTVSSAS

SEQ ID NO: 239 - protein, 124 aa, Artificial Sequence
  Description of Artificial Sequence: Synthetic polypeptide
  VH1-46_IGHD6-6*01_IGHJ1*01 S102A/S103P/S104F F109X
  misc_feature (109)..(109): Xaa is an unknown amino acid residue
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYXQHWGQGTLVTVSSAS

SEQ ID NO: 240 - protein, 124 aa, Artificial Sequence
  Description of Artificial Sequence: Synthetic polypeptide
  VH1-46_IGHD6-6*01_IGHJ1*01 S102A/S103P/S104F H111X
  misc_feature (111)..(111): Xaa is an unknown amino acid residue
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYAPFSAEYFQXWGQGTLVTVSSAS

SEQ ID NO: 241 - protein, 124 aa, Artificial Sequence
  Description of Artificial Sequence: Synthetic polypeptide
  VH1-46_IGHD6-6*01_IGHJ1*01 S102A/S103P/S104F/H111F G56E/G
  MOD_RES (56)..(56): Gly or Glu
QVQLVQSGAEVKKPGASVKVSCKASGYTFTSYYMHWVRQAPGQGLEWMGIINPSGXSTSYAQKFQGRVTMTRDTSTSTVYMELSSLRSEDTAVYYCAREEYAPFSAEYFQFWGQGTLVTVSSAS

SEQ ID NO: 242 - protein, 124 aa, Artificial Sequence; identical to SEQ ID NO: 241
  Description of Artificial Sequence: Synthetic polypeptide
  VH1-46_IGHD6-6*01_IGHJ1*01 S102A/S103P/S104F/H111F G56V/N
  MOD_RES (56)..(56): Val or Asn

SEQ ID NO: 243 - protein, 124 aa, Artificial Sequence; identical to SEQ ID NO: 241
  Description of Artificial Sequence: Synthetic polypeptide
  VH1-46_IGHD6-6*01_IGHJ1*01 S102A/S103P/S104F/H111F G56E/D
  MOD_RES (56)..(56): Glu or Asp

SEQ ID NO: 244 - protein, 110 aa, Artificial Sequence
  Description of Artificial Sequence: Synthetic polypeptide
  L6_IGKJ1*01 S28P
EIVLTQSPATLSLSPGERATLSCRASQPVSSYLAWYQQKPGQAPRLLIYDASNRATGIPARFSGSGSGTDFTLTISSLEPEDFAVYYCQQRSNWPPWTFGQGTKVEIKRT

SEQ ID NO: 245 - protein, 110 aa, Artificial Sequence
  Description of Artificial Sequence: Synthetic polypeptide
  L6_IGKJ1*01 S30N
EIVLTQSPATLSLSPGERATLSCRASQSVNSYLAWYQQKPGQAPRLLIYDASNRATGIPARFSGSGSGTDFTLTISSLEPEDFAVYYCQQRSNWPPWTFGQGTKVEIKRT

SEQ ID NO: 246 - protein, 110 aa, Artificial Sequence
  Description of Artificial Sequence: Synthetic polypeptide
  L6_IGKJ1*01 S31K
EIVLTQSPATLSLSPGERATLSCRASQSVSKYLAWYQQKPGQAPRLLIYDASNRATGIPARFSGSGSGTDFTLTISSLEPEDFAVYYCQQRSNWPPWTFGQGTKVEIKRT

SEQ ID NO: 247 - protein, 110 aa, Artificial Sequence
  Description of Artificial Sequence: Synthetic polypeptide
  L6_IGKJ1*01 R91P
EIVLTQSPATLSLSPGERATLSCRASQSVSSYLAWYQQKPGQAPRLLIYDASNRATGIPARFSGSGSGTDFTLTISSLEPEDFAVYYCQQPSNWPPWTFGQGTKVEIKRT

SEQ ID NO: 248 - protein, 110 aa, Artificial Sequence
  Description of Artificial Sequence: Synthetic polypeptide
  L6_IGKJ1*01 R91L
EIVLTQSPATLSLSPGERATLSCRASQSVSSYLAWYQQKPGQAPRLLIYDASNRATGIPARFSGSGSGTDFTLTISSLEPEDFAVYYCQQLSNWPPWTFGQGTKVEIKRT

SEQ ID NO: 249 - protein, 110 aa, Artificial Sequence
  Description of Artificial Sequence: Synthetic polypeptide
  L6_IGKJ1*01 R91G
EIVLTQSPATLSLSPGERATLSCRASQSVSSYLAWYQQKPGQAPRLLIYDASNRATGIPARFSGSGSGTDFTLTISSLEPEDFAVYYCQQGSNWPPWTFGQGTKVEIKRT

SEQ ID NO: 250 - protein, 110 aa, Artificial Sequence
  Description of Artificial Sequence: Synthetic polypeptide
  L6_IGKJ1*01 R91Q
EIVLTQSPATLSLSPGERATLSCRASQSVSSYLAWYQQKPGQAPRLLIYDASNRATGIPARFSGSGSGTDFTLTISSLEPEDFAVYYCQQQSNWPPWTFGQGTKVEIKRT

SEQ ID NO: 251 - protein, 110 aa, Artificial Sequence
  Description of Artificial Sequence: Synthetic polypeptide
  L6_IGKJ1*01 S92N
EIVLTQSPATLSLSPGERATLSCRASQSVSSYLAWYQQKPGQAPRLLIYDASNRATGIPARFSGSGSGTDFTLTISSLEPEDFAVYYCQQRNNWPPWTFGQGTKVEIKRT

SEQ ID NO: 252 - protein, 110 aa, Artificial Sequence
  Description of Artificial Sequence: Synthetic polypeptide
  L6_IGKJ1*01 S92C
EIVLTQSPATLSLSPGERATLSCRASQSVSSYLAWYQQKPGQAPRLLIYDASNRATGIPARFSGSGSGTDFTLTISSLEPEDFAVYYCQQRCNWPPWTFGQGTKVEIKRT

SEQ ID NO: 253 - protein, 110 aa, Artificial Sequence
  Description of Artificial Sequence: Synthetic polypeptide
  L6_IGKJ1*01 N93Y
EIVLTQSPATLSLSPGERATLSCRASQSVSSYLAWYQQKPGQAPRLLIYDASNRATGIPARFSGSGSGTDFTLTISSLEPEDFAVYYCQQRSYWPPWTFGQGTKVEIKRT

SEQ ID NO: 254 - protein, 110 aa, Artificial Sequence
  Description of Artificial Sequence: Synthetic polypeptide
  L6_IGKJ1*01 N93S
EIVLTQSPATLSLSPGERATLSCRASQSVSSYLAWYQQKPGQAPRLLIYDASNRATGIPARFSGSGSGTDFTLTISSLEPEDFAVYYCQQRSSWPPWTFGQGTKVEIKRT

SEQ ID NO: 255 - protein, 110 aa, Artificial Sequence
  Description of Artificial Sequence: Synthetic polypeptide
  L6_IGKJ1*01 N93H
EIVLTQSPATLSLSPGERATLSCRASQSVSSYLAWYQQKPGQAPRLLIYDASNRATGIPARFSGSGSGTDFTLTISSLEPEDFAVYYCQQRSHWPPWTFGQGTKVEIKRT

SEQ ID NO: 256 - protein, 110 aa, Artificial Sequence
  Description of Artificial Sequence: Synthetic polypeptide
  L6_IGKJ1*01 N93Q
EIVLTQSPATLSLSPGERATLSCRASQSVSSYLAWYQQKPGQAPRLLIYDASNRATGIPARFSGSGSGTDFTLTISSLEPEDFAVYYCQQRSQWPPWTFGQGTKVEIKRT

SEQ ID NO: 257 - protein, 110 aa, Artificial Sequence
  Description of Artificial Sequence: Synthetic polypeptide
  L6_IGKJ1*01 W94R
EIVLTQSPATLSLSPGERATLSCRASQSVSSYLAWYQQKPGQAPRLLIYDASNRATGIPARFSGSGSGTDFTLTISSLEPEDFAVYYCQQRSNRPPWTFGQGTKVEIKRT

SEQ ID NO: 258 - protein, 110 aa, Artificial Sequence
  Description of Artificial Sequence: Synthetic polypeptide
  L6_IGKJ1*01 W94S
EIVLTQSPATLSLSPGERATLSCRASQSVSSYLAWYQQKPGQAPRLLIYDASNRATGIPARFSGSGSGTDFTLTISSLEPEDFAVYYCQQRSNSPPWTFGQGTKVEIKRT

SEQ ID NO: 259 - protein, 110 aa, Artificial Sequence
  Description of Artificial Sequence: Synthetic polypeptide
  L6_IGKJ1*01 W94T
EIVLTQSPATLSLSPGERATLSCRASQSVSSYLAWYQQKPGQAPRLLIYDASNRATGIPARFSGSGSGTDFTLTISSLEPEDFAVYYCQQRSNTPPWTFGQGTKVEIKRT

SEQ ID NO: 260 - protein, 110 aa, Artificial Sequence
  Description of Artificial Sequence: Synthetic polypeptide
  L6_IGKJ1*01 W94L
EIVLTQSPATLSLSPGERATLSCRASQSVSSYLAWYQQKPGQAPRLLIYDASNRATGIPARFSGSGSGTDFTLTISSLEPEDFAVYYCQQRSNLPPWTFGQGTKVEIKRT

SEQ ID NO: 261 - protein, 110 aa, Artificial Sequence
  Description of Artificial Sequence: Synthetic polypeptide
  L6_IGKJ1*01 W94P
EIVLTQSPATLSLSPGERATLSCRASQSVSSYLAWYQQKPGQAPRLLIYDASNRATGIPARFSGSGSGTDFTLTISSLEPEDFAVYYCQQRSNPPPWTFGQGTKVEIKRT

SEQ ID NO: 262 - protein, 110 aa, Artificial Sequence
  Description of Artificial Sequence: Synthetic polypeptide
  L6_IGKJ1*01 W94M
EIVLTQSPATLSLSPGERATLSCRASQSVSSYLAWYQQKPGQAPRLLIYDASNRATGIPARFSGSGSGTDFTLTISSLEPEDFAVYYCQQRSNMPPWTFGQGTKVEIKRT

SEQ ID NO: 263 - protein, 110 aa, Artificial Sequence
  Description of Artificial Sequence: Synthetic polypeptide
  L6_IGKJ1*01 S92P
EIVLTQSPATLSLSPGERATLSCRASQSVSSYLAWYQQKPGQAPRLLIYDASNRATGIPARFSGSGSGTDFTLTISSLEPEDFAVYYCQQRPNWPPWTFGQGTKVEIKRT

SEQ ID NO: 264 - protein, 124 aa, Artificial Sequence
  Description of Artificial Sequence: Synthetic polypeptide
  VH1-46_IGHD6-6*01_IGHJ1*01 S102A/S103P/S104F/H111F S54Q
QVQLVQSGAEVKKPGASVKVSCKASGYTFTSYYMHWVRQAPGQGLEWMGIINPQGGSTSYAQKFQGRVTMTRDTSTSTVYMELSSLRSEDTAVYYCAREEYAPFSAEYFQFWGQGTLVTVSSAS

SEQ ID NO: 265 - protein, 110 aa, Artificial Sequence
  Description of Artificial Sequence: Synthetic polypeptide
  L6_IGKJ1*01 S92Q
EIVLTQSPATLSLSPGERATLSCRASQSVSSYLAWYQQKPGQAPRLLIYDASNRATGIPARFSGSGSGTDFTLTISSLEPEDFAVYYCQQRQNWPPWTFGQGTKVEIKRT

SEQ ID NO: 266 - protein, 110 aa, Artificial Sequence
  Description of Artificial Sequence: Synthetic polypeptide
  L6_IGKJ1*01 S92V
EIVLTQSPATLSLSPGERATLSCRASQSVSSYLAWYQQKPGQAPRLLIYDASNRATGIPARFSGSGSGTDFTLTISSLEPEDFAVYYCQQRVNWPPWTFGQGTKVEIKRT

SEQ ID NO: 267 - protein, 110 aa, Artificial Sequence
  Description of Artificial Sequence: Synthetic polypeptide
  L6_IGKJ1*01 S92T
EIVLTQSPATLSLSPGERATLSCRASQSVSSYLAWYQQKPGQAPRLLIYDASNRATGIPARFSGSGSGTDFTLTISSLEPEDFAVYYCQQRTNWPPWTFGQGTKVEIKRT

SEQ ID NO: 268 - protein, 110 aa, Artificial Sequence
  Description of Artificial Sequence: Synthetic polypeptide
  L6_IGKJ1*01 S92R
EIVLTQSPATLSLSPGERATLSCRASQSVSSYLAWYQQKPGQAPRLLIYDASNRATGIPARFSGSGSGTDFTLTISSLEPEDFAVYYCQQRRNWPPWTFGQGTKVEIKRT

SEQ ID NO: 269 - protein, 110 aa, Artificial Sequence
  Description of Artificial Sequence: Synthetic polypeptide
  L6_IGKJ1*01 S92G
EIVLTQSPATLSLSPGERATLSCRASQSVSSYLAWYQQKPGQAPRLLIYDASNRATGIPARFSGSGSGTDFTLTISSLEPEDFAVYYCQQRGNWPPWTFGQGTKVEIKRT

SEQ ID NO: 270 - protein, 110 aa, Artificial Sequence; identical to SEQ ID NO: 266
  Description of Artificial Sequence: Synthetic polypeptide
  L6_IGKJ1*01 S92V

SEQ ID NO: 271 - protein, 110 aa, Artificial Sequence
  Description of Artificial Sequence: Synthetic polypeptide
  L6_IGKJ1*01 S92M
EIVLTQSPATLSLSPGERATLSCRASQSVSSYLAWYQQKPGQAPRLLIYDASNRATGIPARFSGSGSGTDFTLTISSLEPEDFAVYYCQQRMNWPPWTFGQGTKVEIKRT

SEQ ID NO: 272 - protein, 110 aa, Artificial Sequence
  Description of Artificial Sequence: Synthetic polypeptide
  L6_IGKJ1*01 S30W
EIVLTQSPATLSLSPGERATLSCRASQSVWSYLAWYQQKPGQAPRLLIYDASNRATGIPARFSGSGSGTDFTLTISSLEPEDFAVYYCQQRSNWPPWTFGQGTKVEIKRT

SEQ ID NO: 273 - protein, 110 aa, Artificial Sequence
  Description of Artificial Sequence: Synthetic polypeptide
  L6_IGKJ1*01 S30R
EIVLTQSPATLSLSPGERATLSCRASQSVRSYLAWYQQKPGQAPRLLIYDASNRATGIPARFSGSGSGTDFTLTISSLEPEDFAVYYCQQRSNWPPWTFGQGTKVEIKRT

SEQ ID NO: 274 - protein, 110 aa, Artificial Sequence
  Description of Artificial Sequence: Synthetic polypeptide
  L6_IGKJ1*01 S30T
EIVLTQSPATLSLSPGERATLSCRASQSVTSYLAWYQQKPGQAPRLLIYDASNRATGIPARFSGSGSGTDFTLTISSLEPEDFAVYYCQQRSNWPPWTFGQGTKVEIKRT

SEQ ID NO: 275 - protein, 110 aa, Artificial Sequence
  Description of Artificial Sequence: Synthetic polypeptide
  L6_IGKJ1*01 S30L
EIVLTQSPATLSLSPGERATLSCRASQSVLSYLAWYQQKPGQAPRLLIYDASNRATGIPARFSGSGSGTDFTLTISSLEPEDFAVYYCQQRSNWPPWTFGQGTKVEIKRT

SEQ ID NO: 276 - protein, 110 aa, Artificial Sequence
  Description of Artificial Sequence: Synthetic polypeptide
  L6_IGKJ1*01 R24G/Q27L
EIVLTQSPATLSLSPGERATLSCGASLSVSSYLAWYQQKPGQAPRLLIYDASNRATGIPARFSGSGSGTDFTLTISSLEPEDFAVYYCQQRSNWPPWTFGQGTKVEIKRT

SEQ ID NO: 277 - protein, 110 aa, Artificial Sequence
  Description of Artificial Sequence: Synthetic polypeptide
  L6_IGKJ1*01 Y32V
EIVLTQSPATLSLSPGERATLSCRASQSVSSVLAWYQQKPGQAPRLLIYDASNRATGIPARFSGSGSGTDFTLTISSLEPEDFAVYYCQQRSNWPPWTFGQGTKVEIKRT

SEQ ID NO: 278 - protein, 110 aa, Artificial Sequence
  Description of Artificial Sequence: Synthetic polypeptide
  L6_IGKJ1*01 Y32S
EIVLTQSPATLSLSPGERATLSCRASQSVSSSLAWYQQKPGQAPRLLIYDASNRATGIPARFSGSGSGTDFTLTISSLEPEDFAVYYCQQRSNWPPWTFGQGTKVEIKRT

SEQ ID NO: 279 - protein, 110 aa, Artificial Sequence
  Description of Artificial Sequence: Synthetic polypeptide
  L6_IGKJ1*01 S28G
EIVLTQSPATLSLSPGERATLSCRASQGVSSYLAWYQQKPGQAPRLLIYDASNRATGIPARFSGSGSGTDFTLTISSLEPEDFAVYYCQQRSNWPPWTFGQGTKVEIKRT

SEQ ID NO: 280 - protein, 110 aa, Artificial Sequence
  Description of Artificial Sequence: Synthetic polypeptide
  L6_IGKJ1*01 S28K
EIVLTQSPATLSLSPGERATLSCRASQKVSSYLAWYQQKPGQAPRLLIYDASNRATGIPARFSGSGSGTDFTLTISSLEPEDFAVYYCQQRSNWPPWTFGQGTKVEIKRT

SEQ ID NO: 281 - protein, 110 aa, Artificial Sequence
  Description of Artificial Sequence: Synthetic polypeptide
  L6_IGKJ1*01 S28V
EIVLTQSPATLSLSPGERATLSCRASQVVSSYLAWYQQKPGQAPRLLIYDASNRATGIPARFSGSGSGTDFTLTISSLEPEDFAVYYCQQRSNWPPWTFGQGTKVEIKRT

SEQ ID NO: 282 - protein, 110 aa, Artificial Sequence
  Description of Artificial Sequence: Synthetic polypeptide
  L6_IGKJ1*01 S28F
EIVLTQSPATLSLSPGERATLSCRASQFVSSYLAWYQQKPGQAPRLLIYDASNRATGIPARFSGSGSGTDFTLTISSLEPEDFAVYYCQQRSNWPPWTFGQGTKVEIKRT

SEQ ID NO: 283 - protein, 110 aa, Artificial Sequence
  Description of Artificial Sequence: Synthetic polypeptide
  L6_IGKJ1*01 S28T
EIVLTQSPATLSLSPGERATLSCRASQTVSSYLAWYQQKPGQAPRLLIYDASNRATGIPARFSGSGSGTDFTLTISSLEPEDFAVYYCQQRSNWPPWTFGQGTKVEIKRT

SEQ ID NO: 284 - protein, 110 aa, Artificial Sequence
  Description of Artificial Sequence: Synthetic polypeptide
  L6_IGKJ1*01 S28L
EIVLTQSPATLSLSPGERATLSCRASQLVSSYLAWYQQKPGQAPRLLIYDASNRATGIPARFSGSGSGTDFTLTISSLEPEDFAVYYCQQRSNWPPWTFGQGTKVEIKRT

SEQ ID NO: 285 - protein, 110 aa, Artificial Sequence
  Description of Artificial Sequence: Synthetic polypeptide
  L6_IGKJ1*01 S28Q
EIVLTQSPATLSLSPGERATLSCRASQQVSSYLAWYQQKPGQAPRLLIYDASNRATGIPARFSGSGSGTDFTLTISSLEPEDFAVYYCQQRSNWPPWTFGQGTKVEIKRT

SEQ ID NO: 286 - protein, 110 aa, Artificial Sequence
  Description of Artificial Sequence: Synthetic polypeptide
  L6_IGKJ1*01 S28A
EIVLTQSPATLSLSPGERATLSCRASQAVSSYLAWYQQKPGQAPRLLIYDASNRATGIPARFSGSGSGTDFTLTISSLEPEDFAVYYCQQRSNWPPWTFGQGTKVEIKRT

SEQ ID NO: 287 - protein, 110 aa, Artificial Sequence
  Description of Artificial Sequence: Synthetic polypeptide
  L6_IGKJ1*01 S28N
EIVLTQSPATLSLSPGERATLSCRASQNVSSYLAWYQQKPGQAPRLLIYDASNRATGIPARFSGSGSGTDFTLTISSLEPEDFAVYYCQQRSNWPPWTFGQGTKVEIKRT

SEQ ID NO: 288 - protein, 110 aa, Artificial Sequence
  Description of Artificial Sequence: Synthetic polypeptide
  L6_IGKJ1*01 S28H
EIVLTQSPATLSLSPGERATLSCRASQHVSSYLAWYQQKPGQAPRLLIYDASNRATGIPARFSGSGSGTDFTLTISSLEPEDFAVYYCQQRSNWPPWTFGQGTKVEIKRT

SEQ ID NO: 289 - protein, 110 aa, Artificial Sequence
  Description of Artificial Sequence: Synthetic polypeptide
  L6_IGKJ1*01 S28I
EIVLTQSPATLSLSPGERATLSCRASQIVSSYLAWYQQKPGQAPRLLIYDASNRATGIPARFSGSGSGTDFTLTISSLEPEDFAVYYCQQRSNWPPWTFGQGTKVEIKRT

SEQ ID NO: 290 - protein, 110 aa, Artificial Sequence
  Description of Artificial Sequence: Synthetic polypeptide
  L6_IGKJ1*01 S28R
EIVLTQSPATLSLSPGERATLSCRASQRVSSYLAWYQQKPGQAPRLLIYDASNRATGIPARFSGSGSGTDFTLTISSLEPEDFAVYYCQQRSNWPPWTFGQGTKVEIKRT

SEQ ID NO: 291 - protein, 110 aa, Artificial Sequence
  Description of Artificial Sequence: Synthetic polypeptide
  L6_IGKJ1*01 S28W
EIVLTQSPATLSLSPGERATLSCRASQWVSSYLAWYQQKPGQAPRLLIYDASNRATGIPARFSGSGSGTDFTLTISSLEPEDFAVYYCQQRSNWPPWTFGQGTKVEIKRT

SEQ ID NO: 292 - protein, 110 aa, Artificial Sequence
  Description of Artificial Sequence: Synthetic polypeptide
  L6_IGKJ1*01 S28M
EIVLTQSPATLSLSPGERATLSCRASQMVSSYLAWYQQKPGQAPRLLIYDASNRATGIPARFSGSGSGTDFTLTISSLEPEDFAVYYCQQRSNWPPWTFGQGTKVEIKRT

SEQ ID NO: 293 - protein, 110 aa, Artificial Sequence
  Description of Artificial Sequence: Synthetic polypeptide
  L6_IGKJ1*01 S28E
EIVLTQSPATLSLSPGERATLSCRASQEVSSYLAWYQQKPGQAPRLLIYDASNRATGIPARFSGSGSGTDFTLTISSLEPEDFAVYYCQQRSNWPPWTFGQGTKVEIKRT

SEQ ID NO: 294 - protein, 110 aa, Artificial Sequence
  Description of Artificial Sequence: Synthetic polypeptide
  L6_IGKJ1*01 S30C
EIVLTQSPATLSLSPGERATLSCRASQSVCSYLAWYQQKPGQAPRLLIYDASNRATGIPARFSGSGSGTDFTLTISSLEPEDFAVYYCQQRSNWPPWTFGQGTKVEIKRT

SEQ ID NO: 295 - protein, 110 aa, Artificial Sequence
  Description of Artificial Sequence: Synthetic polypeptide
  L6_IGKJ1*01 S30D
EIVLTQSPATLSLSPGERATLSCRASQSVDSYLAWYQQKPGQAPRLLIYDASNRATGIPARFSGSGSGTDFTLTISSLEPEDFAVYYCQQRSNWPPWTFGQGTKVEIKRT

SEQ ID NO: 296 - protein, 110 aa, Artificial Sequence; identical to SEQ ID NO: 275
  Description of Artificial Sequence: Synthetic polypeptide
  L6_IGKJ1*01 S30L

SEQ ID NO: 297 - protein, 110 aa, Artificial Sequence; identical to SEQ ID NO: 274
  Description of Artificial Sequence: Synthetic polypeptide
  L6_IGKJ1*01 S30T

SEQ ID NO: 298 - protein, 110 aa, Artificial Sequence; identical to SEQ ID NO: 273
  Description of Artificial Sequence: Synthetic polypeptide
  L6_IGKJ1*01 S30R

SEQ ID NO: 299 - protein, 110 aa, Artificial Sequence
  Description of Artificial Sequence: Synthetic polypeptide
  L6_IGKJ1*01 S30P
EIVLTQSPATLSLSPGERATLSCRASQSVPSYLAWYQQKPGQAPRLLIYDASNRATGIPARFSGSGSGTDFTLTISSLEPEDFAVYYCQQRSNWPPWTFGQGTKVEIKRT

SEQ ID NO: 300 - protein, 110 aa, Artificial Sequence; identical to SEQ ID NO: 272
  Description of Artificial Sequence: Synthetic polypeptide
  L6_IGKJ1*01 S30W

SEQ ID NO: 301 - protein, 110 aa, Artificial Sequence
  Description of Artificial Sequence: Synthetic polypeptide
  L6_IGKJ1*01 S30Y
EIVLTQSPATLSLSPGERATLSCRASQSVYSYLAWYQQKPGQAPRLLIYDASNRATGIPARFSGSGSGTDFTLTISSLEPEDFAVYYCQQRSNWPPWTFGQGTKVEIKRT

SEQ ID NO: 302 - protein, 110 aa, Artificial Sequence
  Description of Artificial Sequence: Synthetic polypeptide
  L6_IGKJ1*01 S30Q
EIVLTQSPATLSLSPGERATLSCRASQSVQSYLAWYQQKPGQAPRLLIYDASNRATGIPARFSGSGSGTDFTLTISSLEPEDFAVYYCQQRSNWPPWTFGQGTKVEIKRT

SEQ ID NO: 303 - protein, 110 aa, Artificial Sequence
  Description of Artificial Sequence: Synthetic polypeptide
  L6_IGKJ1*01 S30A
EIVLTQSPATLSLSPGERATLSCRASQSVASYLAWYQQKPGQAPRLLIYDASNRATGIPARFSGSGSGTDFTLTISSLEPEDFAVYYCQQRSNWPPWTFGQGTKVEIKRT

SEQ ID NO: 304 - protein, 110 aa, Artificial Sequence
  Description of Artificial Sequence: Synthetic polypeptide
  L6_IGKJ1*01 S30G
EIVLTQSPATLSLSPGERATLSCRASQSVGSYLAWYQQKPGQAPRLLIYDASNRATGIPARFSGSGSGTDFTLTISSLEPEDFAVYYCQQRSNWPPWTFGQGTKVEIKRT

SEQ ID NO: 305 - protein, 110 aa, Artificial Sequence
  Description of Artificial Sequence: Synthetic polypeptide
  L6_IGKJ1*01 S30V
EIVLTQSPATLSLSPGERATLSCRASQSVVSYLAWYQQKPGQAPRLLIYDASNRATGIPARFSGSGSGTDFTLTISSLEPEDFAVYYCQQRSNWPPWTFGQGTKVEIKRT

SEQ ID NO: 306 - protein, 110 aa, Artificial Sequence
  Description of Artificial Sequence: Synthetic polypeptide
  L6_IGKJ1*01 S31T
EIVLTQSPATLSLSPGERATLSCRASQSVSTYLAWYQQKPGQAPRLLIYDASNRATGIPARFSGSGSGTDFTLTISSLEPEDFAVYYCQQRSNWPPWTFGQGTKVEIKRT

SEQ ID NO: 307 - protein, 110 aa, Artificial Sequence
  Description of Artificial Sequence: Synthetic polypeptide
  L6_IGKJ1*01 S31N
EIVLTQSPATLSLSPGERATLSCRASQSVSNYLAWYQQKPGQAPRLLIYDASNRATGIPARFSGSGSGTDFTLTISSLEPEDFAVYYCQQRSNWPPWTFGQGTKVEIKRT

SEQ ID NO: 308 - protein, 110 aa, Artificial Sequence
  Description of Artificial Sequence: Synthetic polypeptide
  L6_IGKJ1*01 S31L
EIVLTQSPATLSLSPGERATLSCRASQSVSLYLAWYQQKPGQAPRLLIYDASNRATGIPARFSGSGSGTDFTLTISSLEPEDFAVYYCQQRSNWPPWTFGQGTKVEIKRT

SEQ ID NO: 309 - protein, 110 aa, Artificial Sequence
  Description of Artificial Sequence: Synthetic polypeptide
  L6_IGKJ1*01 S31M
EIVLTQSPATLSLSPGERATLSCRASQSVSMYLAWYQQKPGQAPRLLIYDASNRATGIPARFSGSGSGTDFTLTISSLEPEDFAVYYCQQRSNWPPWTFGQGTKVEIKRT

SEQ ID NO: 310 - protein, 110 aa, Artificial Sequence
  Description of Artificial Sequence: Synthetic polypeptide
  L6_IGKJ1*01 S31F
EIVLTQSPATLSLSPGERATLSCRASQSVSFYLAWYQQKPGQAPRLLIYDASNRATGIPARFSGSGSGTDFTLTISSLEPEDFAVYYCQQRSNWPPWTFGQGTKVEIKRT

SEQ ID NO: 311 - protein, 110 aa, Artificial Sequence
  Description of Artificial Sequence: Synthetic polypeptide
  L6_IGKJ1*01 S31I
EIVLTQSPATLSLSPGERATLSCRASQSVSIYLAWYQQKPGQAPRLLIYDASNRATGIPARFSGSGSGTDFTLTISSLEPEDFAVYYCQQRSNWPPWTFGQGTKVEIKRT

SEQ ID NO: 312 - protein, 110 aa, Artificial Sequence
  Description of Artificial Sequence: Synthetic polypeptide
  L6_IGKJ1*01 S31V
EIVLTQSPATLSLSPGERATLSCRASQSVSVYLAWYQQKPGQAPRLLIYDASNRATGIPARFSGSGSGTDFTLTISSLEPEDFAVYYCQQRSNWPPWTFGQGTKVEIKRT

SEQ ID NO: 313 - protein, 110 aa, Artificial Sequence
  Description of Artificial Sequence: Synthetic polypeptide
  L6_IGKJ1*01 S31H
EIVLTQSPATLSLSPGERATLSCRASQSVSHYLAWYQQKPGQAPRLLIYDASNRATGIPARFSGSGSGTDFTLTISSLEPEDFAVYYCQQRSNWPPWTFGQGTKVEIKRT

SEQ ID NO: 314 - protein, 110 aa, Artificial Sequence
  Description of Artificial Sequence: Synthetic polypeptide
  L6_IGKJ1*01 S31A
EIVLTQSPATLSLSPGERATLSCRASQSVSAYLAWYQQKPGQAPRLLIYDASNRATGIPARFSGSGSGTDFTLTISSLEPEDFAVYYCQQRSNWPPWTFGQGTKVEIKRT

SEQ ID NO: 315 - protein, 110 aa, Artificial Sequence
  Description of Artificial Sequence: Synthetic polypeptide
  L6_IGKJ1*01 S31P
EIVLTQSPATLSLSPGERATLSCRASQSVSPYLAWYQQKPGQAPRLLIYDASNRATGIPARFSGSGSGTDFTLTISSLEPEDFAVYYCQQRSNWPPWTFGQGTKVEIKRT

SEQ ID NO: 316 - protein, 110 aa, Artificial Sequence
  Description of Artificial Sequence: Synthetic polypeptide
  L6_IGKJ1*01 S31D
EIVLTQSPATLSLSPGERATLSCRASQSVSDYLAWYQQKPGQAPRLLIYDASNRATGIPARFSGSGSGTDFTLTISSLEPEDFAVYYCQQRSNWPPWTFGQGTKVEIKRT

SEQ ID NO: 317 - protein, 110 aa, Artificial Sequence
  Description of Artificial Sequence: Synthetic polypeptide
  L6_IGKJ1*01 S31R
EIVLTQSPATLSLSPGERATLSCRASQSVSRYLAWYQQKPGQAPRLLIYDASNRATGIPARFSGSGSGTDFTLTISSLEPEDFAVYYCQQRSNWPPWTFGQGTKVEIKRT

SEQ ID NO: 318 - protein, 110 aa, Artificial Sequence
  Description of Artificial Sequence: Synthetic polypeptide
  L6_IGKJ1*01 S31Y
EIVLTQSPATLSLSPGERATLSCRASQSVSYYLAWYQQKPGQAPRLLIYDASNRATGIPARFSGSGSGTDFTLTISSLEPEDFAVYYCQQRSNWPPWTFGQGTKVEIKRT

SEQ ID NO: 319 - protein, 110 aa, Artificial Sequence
  Description of Artificial Sequence: Synthetic polypeptide
  L6_IGKJ1*01 S31Q
EIVLTQSPATLSLSPGERATLSCRASQSVSQYLAWYQQKPGQAPRLLIYDASNRATGIPARFSGSGSGTDFTLTISSLEPEDFAVYYCQQRSNWPPWTFGQGTKVEIKRT

SEQ ID NO: 320 - protein, 110 aa, Artificial Sequence
  Description of Artificial Sequence: Synthetic polypeptide
  L6_IGKJ1*01 S31E
EIVLTQSPATLSLSPGERATLSCRASQSVSEYLAWYQQKPGQAPRLLIYDASNRATGIPARFSGSGSGTDFTLTISSLEPEDFAVYYCQQRSNWPPWTFGQGTKVEIKRT

SEQ ID NO: 321 - protein, 110 aa, Artificial Sequence
  Description of Artificial Sequence: Synthetic polypeptide
  L6_IGKJ1*01 S31G
EIVLTQSPATLSLSPGERATLSCRASQSVSGYLAWYQQKPGQAPRLLIYDASNRATGIPARFSGSGSGTDFTLTISSLEPEDFAVYYCQQRSNWPPWTFGQGTKVEIKRT

SEQ ID NO: 322 - protein, 110 aa, Artificial Sequence
  Description of Artificial Sequence: Synthetic polypeptide
  L6_IGKJ1*01 S28P/S30N/S31K
EIVLTQSPATLSLSPGERATLSCRASQPVNKYLAWYQQKPGQAPRLLIYDASNRATGIPARFSGSGSGTDFTLTISSLEPEDFAVYYCQQRSNWPPWTFGQGTKVEIKRT

SEQ ID NO: 323 - protein, 110 aa, Artificial Sequence
  Description of Artificial Sequence: Synthetic polypeptide
  L6_IGKJ1*01 S28N/S30D/S31H
EIVLTQSPATLSLSPGERATLSCRASQNVDHYLAWYQQKPGQAPRLLIYDASNRATGIPARFSGSGSGTDFTLTISSLEPEDFAVYYCQQRSNWPPWTFGQGTKVEIKRT

SEQ ID NO: 324 - protein, 110 aa, Artificial Sequence
  Description of Artificial Sequence: Synthetic polypeptide
  L6_IGKJ1*01 D50A
EIVLTQSPATLSLSPGERATLSCRASQSVSSYLAWYQQKPGQAPRLLIYAASNRATGIPARFSGSGSGTDFTLTISSLEPEDFAVYYCQQRSNWPPWTFGQGTKVEIKRT

SEQ ID NO: 325 - protein, 110 aa, Artificial Sequence
  Description of Artificial Sequence: Synthetic polypeptide
  L6_IGKJ1*01 A51T
EIVLTQSPATLSLSPGERATLSCRASQSVSSYLAWYQQKPGQAPRLLIYDTSNRATGIPARFSGSGSGTDFTLTISSLEPEDFAVYYCQQRSNWPPWTFGQGTKVEIKRT

SEQ ID NO: 326 - protein, 110 aa, Artificial Sequence
  Description of Artificial Sequence: Synthetic polypeptide
  L6_IGKJ1*01 S52A
EIVLTQSPATLSLSPGERATLSCRASQSVSSYLAWYQQKPGQAPRLLIYDAANRATGIPARFSGSGSGTDFTLTISSLEPEDFAVYYCQQRSNWPPWTFGQGTKVEIKRT

SEQ ID NO: 327 - protein, 110 aa, Artificial Sequence
  Description of Artificial Sequence: Synthetic polypeptide
  L6_IGKJ1*01 N53A
EIVLTQSPATLSLSPGERATLSCRASQSVSSYLAWYQQKPGQAPRLLIYDASARATGIPARFSGSGSGTDFTLTISSLEPEDFAVYYCQQRSNWPPWTFGQGTKVEIKRT

SEQ ID NO: 328 - protein, 110 aa, Artificial Sequence
  Description of Artificial Sequence: Synthetic polypeptide
  L6_IGKJ1*01 R54A
EIVLTQSPATLSLSPGERATLSCRASQSVSSYLAWYQQKPGQAPRLLIYDASNAATGIPARFSGSGSGTDFTLTISSLEPEDFAVYYCQQRSNWPPWTFGQGTKVEIKRT

SEQ ID NO: 329 - protein, 110 aa, Artificial Sequence
  Description of Artificial Sequence: Synthetic polypeptide
  L6_IGKJ1*01 A55T
EIVLTQSPATLSLSPGERATLSCRASQSVSSYLAWYQQKPGQAPRLLIYDASNRTTGIPARFSGSGSGTDFTLTISSLEPEDFAVYYCQQRSNWPPWTFGQGTKVEIKRT

SEQ ID NO: 330 - protein, 110 aa, Artificial Sequence
  Description of Artificial Sequence: Synthetic polypeptide
  L6_IGKJ1*01 T56A
EIVLTQSPATLSLSPGERATLSCRASQSVSSYLAWYQQKPGQAPRLLIYDASNRAAGIPARFSGSGSGTDFTLTISSLEPEDFAVYYCQQRSNWPPWTFGQGTKVEIKRT

SEQ ID NO: 331 - protein, 110 aa, Artificial Sequence
  Description of Artificial Sequence: Synthetic polypeptide
  L6_IGKJ1*01 S28N/S30D/S31H S52L
EIVLTQSPATLSLSPGERATLSCRASQNVDHYLAWYQQKPGQAPRLLIYDALNRATGIPARFSGSGSGTDFTLTISSLEPEDFAVYYCQQRSNWPPWTFGQGTKVEIKRT

SEQ ID NO: 332 - protein, 110 aa, Artificial Sequence
  Description of Artificial Sequence: Synthetic polypeptide
  L6_IGKJ1*01 S28N/S30D/S31H S52T
EIVLTQSPATLSLSPGERATLSCRASQNVDHYLAWYQQKPGQAPRLLIYDATNRATGIPARFSGSGSGTDFTLTISSLEPEDFAVYYCQQRSNWPPWTFGQGTKVEIKRT

SEQ ID NO: 333 - protein, 110 aa, Artificial Sequence
  Description of Artificial Sequence: Synthetic polypeptide
  L6_IGKJ1*01 S28N/S30D/S31H S52R
EIVLTQSPATLSLSPGERATLSCRASQNVDHYLAWYQQKPGQAPRLLIYDARNRATGIPARFSGSGSGTDFTLTISSLEPEDFAVYYCQQRSNWPPWTFGQGTKVEIKRT

SEQ ID NO: 334 - protein, 110 aa, Artificial Sequence
  Description of Artificial Sequence: Synthetic polypeptide
  L6_IGKJ1*01 S28N/S30D/S31H S52W
EIVLTQSPATLSLSPGERATLSCRASQNVDHYLAWYQQKPGQAPRLLIYDAWNRATGIPARFSGSGSGTDFTLTISSLEPEDFAVYYCQQRSNWPPWTFGQGTKVEIKRT

SEQ ID NO: 335 - protein, 110 aa, Artificial Sequence
  Description of Artificial Sequence: Synthetic polypeptide
  L6_IGKJ1*01 S28N/S30D/S31H S52N
EIVLTQSPATLSLSPGERATLSCRASQNVDHYLAWYQQKPGQAPRLLIYDANNRATGIPARFSGSGSGTDFTLTISSLEPEDFAVYYCQQRSNWPPWTFGQGTKVEIKRT

SEQ ID NO: 336 - protein, 110 aa, Artificial Sequence
  Description of Artificial Sequence: Synthetic polypeptide
  L6_IGKJ1*01 S28N/S30D/S31H S52P
EIVLTQSPATLSLSPGERATLSCRASQNVDHYLAWYQQKPGQAPRLLIYDAPNRATGIPARFSGSGSGTDFTLTISSLEPEDFAVYYCQQRSNWPPWTFGQGTKVEIKRT

SEQ ID NO: 337 - protein, 110 aa, Artificial Sequence
  Description of Artificial Sequence: Synthetic polypeptide
  L6_IGKJ1*01 S28N/S30D/S31H S52M
EIVLTQSPATLSLSPGERATLSCRASQNVDHYLAWYQQKPGQAPRLLIYDAMNRATGIPARFSGSGSGTDFTLTISSLEPEDFAVYYCQQRSNWPPWTFGQGTKVEIKRT

SEQ ID NO: 338 - protein, 110 aa, Artificial Sequence
  Description of Artificial Sequence: Synthetic polypeptide
  L6_IGKJ1*01 S28N/S30D/S31H N53E
EIVLTQSPATLSLSPGERATLSCRASQNVDHYLAWYQQKPGQAPRLLIYDASERATGIPARFSGSGSGTDFTLTISSLEPEDFAVYYCQQRSNWPPWTFGQGTKVEIKRT

SEQ ID NO: 339 - protein, 110 aa, Artificial Sequence
  Description of Artificial Sequence: Synthetic polypeptide
  L6_IGKJ1*01 S28N/S30D/S31H N53G
EIVLTQSPATLSLSPGERATLSCRASQNVDHYLAWYQQKPGQAPRLLIYDASGRATGIPARFSGSGSGTDFTLTISSLEPEDFAVYYCQQRSNWPPWTFGQGTKVEIKRT

SEQ ID NO: 340 - protein, 110 aa, Artificial Sequence
  Description of Artificial Sequence: Synthetic polypeptide
  L6_IGKJ1*01 S28N/S30D/S31H N53M
EIVLTQSPATLSLSPGERATLSCRASQNVDHYLAWYQQKPGQAPRLLIYDASMRATGIPARFSGSGSGTDFTLTISSLEPEDFAVYYCQQRSNWPPWTFGQGTKVEIKRT

SEQ ID NO: 341 - protein, 110 aa, Artificial Sequence
  Description of Artificial Sequence: Synthetic polypeptide
  L6_IGKJ1*01 S28N/S30D/S31H N53C
EIVLTQSPATLSLSPGERATLSCRASQNVDHYLAWYQQKPGQAPRLLIYDASCRATGIPARFSGSGSGTDFTLTISSLEPEDFAVYYCQQRSNWPPWTFGQGTKVEIKRT

SEQ ID NO: 342 - protein, 110 aa, Artificial Sequence
  Description of Artificial Sequence: Synthetic polypeptide
  L6_IGKJ1*01 S28N/S30D/S31H N53H
EIVLTQSPATLSLSPGERATLSCRASQNVDHYLAWYQQKPGQAPRLLIYDASHRATGIPARFSGSGSGTDFTLTISSLEPEDFAVYYCQQRSNWPPWTFGQGTKVEIKRT

SEQ ID NO: 343 - protein, 110 aa, Artificial Sequence
  Description of Artificial Sequence: Synthetic polypeptide
  L6_IGKJ1*01 S28N/S30D/S31H N53P
EIVLTQSPATLSLSPGERATLSCRASQNVDHYLAWYQQKPGQAPRLLIYDASPRATGIPARFSGSGSGTDFTLTISSLEPEDFAVYYCQQRSNWPPWTFGQGTKVEIKRT

SEQ ID NO: 344 - protein, 110 aa, Artificial Sequence
  Description of Artificial Sequence: Synthetic polypeptide
  L6_IGKJ1*01 S28N/S30D/S31H N53A
EIVLTQSPATLSLSPGERATLSCRASQNVDHYLAWYQQKPGQAPRLLIYDASARATGIPARFSGSGSGTDFTLTISSLEPEDFAVYYCQQRSNWPPWTFGQGTKVEIKRT

SEQ ID NO: 345 - protein, 110 aa, Artificial Sequence
  Description of Artificial Sequence: Synthetic polypeptide
  L6_IGKJ1*01 S28N/S30D/S31H A55R
EIVLTQSPATLSLSPGERATLSCRASQNVDHYLAWYQQKPGQAPRLLIYDASNRRTGIPARFSGSGSGTDFTLTISSLEPEDFAVYYCQQRSNWPPWTFGQGTKVEIKRT

SEQ ID NO: 346 - protein, 110 aa, Artificial Sequence
  Description of Artificial Sequence: Synthetic polypeptide
  L6_IGKJ1*01 S28N/S30D/S31H A55C
EIVLTQSPATLSLSPGERATLSCRASQNVDHYLAWYQQKPGQAPRLLIYDASNRCTGIPARFSGSGSGTDFTLTISSLEPEDFAVYYCQQRSNWPPWTFGQGTKVEIKRT

SEQ ID NO: 347 - protein, 110 aa, Artificial Sequence
  Description of Artificial Sequence: Synthetic polypeptide
  L6_IGKJ1*01 S28N/S30D/S31H A55S
EIVLTQSPATLSLSPGERATLSCRASQNVDHYLAWYQQKPGQAPRLLIYDASNRSTGIPARFSGSGSGTDFTLTISSLEPEDFAVYYCQQRSNWPPWTFGQGTKVEIKRT

SEQ ID NO: 348 - protein, 110 aa, Artificial Sequence; identical to SEQ ID NO: 323
  Description of Artificial Sequence: Synthetic polypeptide
  L6_IGKJ1*01 S28N/S30D/S31H A55G

SEQ ID NO: 349 - protein, 110 aa, Artificial Sequence
  Description of Artificial Sequence: Synthetic polypeptide
  L6_IGKJ1*01 S28N/S30D/S31H S52L/A55G
EIVLTQSPATLSLSPGERATLSCRASQNVDHYLAWYQQKPGQAPRLLIYDALNRGTGIPARFSGSGSGTDFTLTISSLEPEDFAVYYCQQRSNWPPWTFGQGTKVEIKRT

SEQ ID NO: 350 - protein, 110 aa, Artificial Sequence
  Description of Artificial Sequence: Synthetic polypeptide
  L6_IGKJ1*01 S28N/S30D/S31H S52L/A55S
EIVLTQSPATLSLSPGERATLSCRASQNVDHYLAWYQQKPGQAPRLLIYDALNRSTGIPARFSGSGSGTDFTLTISSLEPEDFAVYYCQQRSNWPPWTFGQGTKVEIKRT

SEQ ID NO: 351 - protein, 110 aa, Artificial Sequence
  Description of Artificial Sequence: Synthetic polypeptide
  L6_IGKJ1*01 S76L
EIVLTQSPATLSLSPGERATLSCRASQSVSSYLAWYQQKPGQAPRLLIYDASNRATGIPARFSGSGSGTDFTLTILSLEPEDFAVYYCQQRSNWPPWTFGQGTKVEIKRT

SEQ ID NO: 352 - protein, 110 aa, Artificial Sequence
  Description of Artificial Sequence: Synthetic polypeptide
  L6_IGKJ1*01 S76T
EIVLTQSPATLSLSPGERATLSCRASQSVSSYLAWYQQKPGQAPRLLIYDASNRATGIPARFSGSGSGTDFTLTITSLEPEDFAVYYCQQRSNWPPWTFGQGTKVEIKRT

SEQ ID NO: 353 - protein, 110 aa, Artificial Sequence
  Description of Artificial Sequence: Synthetic polypeptide
  L6_IGKJ1*01 S76G
EIVLTQSPATLSLSPGERATLSCRASQSVSSYLAWYQQKPGQAPRLLIYDASNRATGIPARFSGSGSGTDFTLTIGSLEPEDFAVYYCQQRSNWPPWTFGQGTKVEIKRT

SEQ ID NO: 354 - protein, 110 aa, Artificial Sequence
  Description of Artificial Sequence: Synthetic polypeptide
  L6_IGKJ1*01 S76A
EIVLTQSPATLSLSPGERATLSCRASQSVSSYLAWYQQKPGQAPRLLIYDASNRATGIPARFSGSGSGTDFTLTIASLEPEDFAVYYCQQRSNWPPWTFGQGTKVEIKRT

SEQ ID NO: 355 - protein, 110 aa, Artificial Sequence
  Description of Artificial Sequence: Synthetic polypeptide
  L6_IGKJ1*01 S76Y
EIVLTQSPATLSLSPGERATLSCRASQSVSSYLAWYQQKPGQAPRLLIYDASNRATGIPARFSGSGSGTDFTLTIYSLEPEDFAVYYCQQRSNWPPWTFGQGTKVEIKRT

SEQ ID NO: 356 - protein, 110 aa, Artificial Sequence
  Description of Artificial Sequence: Synthetic polypeptide
  L6_IGKJ1*01 F62L
EIVLTQSPATLSLSPGERATLSCRASQSVSSYLAWYQQKPGQAPRLLIYDASNRATGIPARLSGSGSGTDFTLTISSLEPEDFAVYYCQQRSNWPPWTFGQGTKVEIKRT

SEQ ID NO: 357 - protein, 110 aa, Artificial Sequence
  Description of Artificial Sequence: Synthetic polypeptide
  L6_IGKJ1*01 S76E
EIVLTQSPATLSLSPGERATLSCRASQSVSSYLAWYQQKPGQAPRLLIYDASNRATGIPARFSGSGSGTDFTLTIESLEPEDFAVYYCQQRSNWPPWTFGQGTKVEIKRT

SEQ ID NO: 358 - protein, 110 aa, Artificial Sequence
  Description of Artificial Sequence: Synthetic polypeptide
  L6_IGKJ1*01 S76Q
EIVLTQSPATLSLSPGERATLSCRASQSVSSYLAWYQQKPGQAPRLLIYDASNRATGIPARFSGSGSGTDFTLTIQSLEPEDFAVYYCQQRSNWPPWTFGQGTKVEIKRT

SEQ ID NO: 359 - protein, 110 aa, Artificial Sequence
  Description of Artificial Sequence: Synthetic polypeptide
  L6_IGKJ1*01 S76P
EIVLTQSPATLSLSPGERATLSCRASQSVSSYLAWYQQKPGQAPRLLIYDASNRATGIPARFSGSGSGTDFTLTIPSLEPEDFAVYYCQQRSNWPPWTFGQGTKVEIKRT

SEQ ID NO: 360 - protein, 110 aa, Artificial Sequence
  Description of Artificial Sequence: Synthetic polypeptide
  L6_IGKJ1*01 S76N
EIVLTQSPATLSLSPGERATLSCRASQSVSSYLAWYQQKPGQAPRLLIYDASNRATGIPARFSGSGSGTDFTLTINSLEPEDFAVYYCQQRSNWPPWTFGQGTKVEIKRT

SEQ ID NO: 361 - protein, 110 aa, Artificial Sequence
  Description of Artificial Sequence: Synthetic polypeptide
  L6_IGKJ1*01 R91X
  misc_feature (91)..(91): Xaa is an unknown amino acid residue
EIVLTQSPATLSLSPGERATLSCRASQSVSSYLAWYQQKPGQAPRLLIYDASNRATGIPARFSGSGSGTDFTLTISSLEPEDFAVYYCQQXSNWPPWTFGQGTKVEIKRT

SEQ ID NO: 362 - protein, 110 aa, Artificial Sequence
  Description of Artificial Sequence: Synthetic polypeptide
  L6_IGKJ1*01 S92X
  misc_feature (92)..(92): Xaa is an unknown amino acid residue
EIVLTQSPATLSLSPGERATLSCRASQSVSSYLAWYQQKPGQAPRLLIYDASNRATGIPARFSGSGSGTDFTLTISSLEPEDFAVYYCQQRXNWPPWTFGQGTKVEIKRT

SEQ ID NO: 363 - protein, 110 aa, Artificial Sequence; identical to SEQ ID NO: 362
  Description of Artificial Sequence: Synthetic polypeptide
  L6_IGKJ1*01 S92A/X
  MOD_RES (92)..(92): Ala or unknown

SEQ ID NO: 364 - protein, 110 aa, Artificial Sequence
  Description of Artificial Sequence: Synthetic polypeptide
  L6_IGKJ1*01 S30X
  misc_feature (30)..(30): Xaa is an unknown amino acid residue
EIVLTQSPATLSLSPGERATLSCRASQSVXSYLAWYQQKPGQAPRLLIYDASNRATGIPARFSGSGSGTDFTLTISSLEPEDFAVYYCQQRSNWPPWTFGQGTKVEIKRT

SEQ ID NO: 365 - protein, 110 aa, Artificial Sequence
  Description of Artificial Sequence: Synthetic polypeptide
  L6_IGKJ1*01 Y32X
  misc_feature (32)..(32): Xaa is an unknown amino acid residue
EIVLTQSPATLSLSPGERATLSCRASQSVSSXLAWYQQKPGQAPRLLIYDASNRATGIPARFSGSGSGTDFTLTISSLEPEDFAVYYCQQRSNWPPWTFGQGTKVEIKRT

SEQ ID NO: 366 - protein, 110 aa, Artificial Sequence; identical to SEQ ID NO: 364
  Description of Artificial Sequence: Synthetic polypeptide
  L6_IGKJ1*01 S30Y/S
  MOD_RES (30)..(30): Ser or Tyr

SEQ ID NO: 367 - protein, 110 aa, Artificial Sequence
  Description of Artificial Sequence: Synthetic polypeptide
  L6_IGKJ1*01 S28N/S30D/S31H S52G/Y
  MOD_RES (52)..(52): Gly or Tyr
EIVLTQSPATLSLSPGERATLSCRASQNVDHYLAWYQQKPGQAPRLLIYDAXNRATGIPARFSGSGSGTDFTLTISSLEPEDFAVYYCQQRSNWPPWTFGQGTKVEIKRT

SEQ ID NO: 368 - protein, 110 aa, Artificial Sequence; identical to SEQ ID NO: 367
  Description of Artificial Sequence: Synthetic polypeptide
  L6_IGKJ1*01 S28N/S30D/S31H S52T/S
  MOD_RES (52)..(52): Thr or Ser

SEQ ID NO: 369 - protein, 110 aa, Artificial Sequence; identical to SEQ ID NO: 367
  Description of Artificial Sequence: Synthetic polypeptide
  L6_IGKJ1*01 S28N/S30D/S31H S52S/Y
  MOD_RES (52)..(52): Ser or Tyr

SEQ ID NO: 370 - protein, 110 aa, Artificial Sequence; identical to SEQ ID NO: 367
  Description of Artificial Sequence: Synthetic polypeptide
  L6_IGKJ1*01 S28N/S30D/S31H S52X
  misc_feature (52)..(52): Xaa is an unknown amino acid residue

SEQ ID NO: 371 - protein, 110 aa, Artificial Sequence; identical to SEQ ID NO: 367
  Description of Artificial Sequence: Synthetic polypeptide
  L6_IGKJ1*01 S28N/S30D/S31H S52N/X
  MOD_RES (52)..(52): Asn or unknown

SEQ ID NO: 372 - protein, 110 aa, Artificial Sequence; identical to SEQ ID NO: 367
  Description of Artificial Sequence: Synthetic polypeptide
  L6_IGKJ1*01 S28N/S30D/S31H S52P/X
  MOD_RES (52)..(52): Pro or unknown

SEQ ID NO: 373 - protein, 110 aa, Artificial Sequence
  Description of Artificial Sequence: Synthetic polypeptide
  L6_IGKJ1*01 S28N/S30D/S31H N53X
  misc_feature (53)..(53): Xaa is an unknown amino acid residue
EIVLTQSPATLSLSPGERATLSCRASQNVDHYLAWYQQKPGQAPRLLIYDASXRATGIPARFSGSGSGTDFTLTISSLEPEDFAVYYCQQRSNWPPWTFGQGTKVEIKRT

SEQ ID NO: 374 - protein, 110 aa, Artificial Sequence; identical to SEQ ID NO: 373
  Description of Artificial Sequence: Synthetic polypeptide
  L6_IGKJ1*01 S28N/S30D/S31H N53C/F
  MOD_RES (53)..(53): Cys or Phe

SEQ ID NO: 375 - protein, 110 aa, Artificial Sequence; identical to SEQ ID NO: 373
  Description of Artificial Sequence: Synthetic polypeptide
  L6_IGKJ1*01 S28N/S30D/S31H N53M/L
  MOD_RES (53)..(53): Met or Leu

SEQ ID NO: 376 - protein, 110 aa, Artificial Sequence
  Description of Artificial Sequence: Synthetic polypeptide
  L6_IGKJ1*01 S28N/S30D/S31H A55X
  misc_feature (55)..(55): Xaa is an unknown amino acid residue
EIVLTQSPATLSLSPGERATLSCRASQNVDHYLAWYQQKPGQAPRLLIYDASNRXTGIPARFSGSGSGTDFTLTISSLEPEDFAVYYCQQRSNWPPWTFGQGTKVEIKRT

SEQ ID NO: 377 - protein, 110 aa, Artificial Sequence
  Description of Artificial Sequence: Synthetic polypeptide
  L6_IGKJ1*01 S76A/K
  MOD_RES (76)..(76): Ala or Lys
EIVLTQSPATLSLSPGERATLSCRASQSVSSYLAWYQQKPGQAPRLLIYDASNRATGIPARFSGSGSGTDFTLTIXSLEPEDFAVYYCQQRSNWPPWTFGQGTKVEIKRT

SEQ ID NO: 378 - protein, 123 aa, Artificial Sequence
  Description of Artificial Sequence: Synthetic polypeptide
  VH5-51_IGHD5-18*01>3_IGHJ4*01 G100K
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYGYDYFDYWGQGTLVTVSSAS

SEQ ID NO: 379 - protein, 123 aa, Artificial Sequence
  Description of Artificial Sequence: Synthetic polypeptide
  VH5-51_IGHD5-18*01>3_IGHJ4*01 G100R
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRRYSYGYDYFDYWGQGTLVTVSSAS

SEQ ID NO: 380 - protein, 123 aa, Artificial Sequence
  Description of Artificial Sequence: Synthetic polypeptide
  VH5-51_IGHD5-18*01>3_IGHJ4*01 G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYTYDYFDYWGQGTLVTVSSAS

SEQ ID NO: 381 - protein, 123 aa, Artificial Sequence
  Description of Artificial Sequence: Synthetic polypeptide
  VH5-51_IGHD5-18*01>3_IGHJ4*01 G100K/G104T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 382 - protein, 123 aa, Artificial Sequence
  Description of Artificial Sequence: Synthetic polypeptide
  VH5-51_IGHD5-18*01>3_IGHJ4*01 R99A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARAGYSYGYDYFDYWGQGTLVTVSSAS

SEQ ID NO: 383 - protein, 123 aa, Artificial Sequence
  Description of Artificial Sequence: Synthetic polypeptide
  VH5-51_IGHD5-18*01>3_IGHJ4*01 G100A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRAYSYGYDYFDYWGQGTLVTVSSAS

SEQ ID NO: 384 - protein, 123 aa, Artificial Sequence
  Description of Artificial Sequence: Synthetic polypeptide
  VH5-51_IGHD5-18*01>3_IGHJ4*01 Y101A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGASYGYDYFDYWGQGTLVTVSSAS

SEQ ID NO: 385 - protein, 123 aa, Artificial Sequence
  Description of Artificial Sequence: Synthetic polypeptide
  VH5-51_IGHD5-18*01>3_IGHJ4*01 S102A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYAYGYDYFDYWGQGTLVTVSSAS

SEQ ID NO: 386 - protein, 123 aa, Artificial Sequence
  Description of Artificial Sequence: Synthetic polypeptide
  VH5-51_IGHD5-18*01>3_IGHJ4*01 Y103A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSAGYDYFDYWGQGTLVTVSSAS

SEQ ID NO: 387 - protein, 123 aa, Artificial Sequence
  Description of Artificial Sequence: Synthetic polypeptide
  VH5-51_IGHD5-18*01>3_IGHJ4*01 G104A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYAYDYFDYWGQGTLVTVSSAS

SEQ ID NO: 388 - protein, 123 aa, Artificial Sequence
  Description of Artificial Sequence: Synthetic polypeptide
  VH5-51_IGHD5-18*01>3_IGHJ4*01 Y105A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGADYFDYWGQGTLVTVSSAS

SEQ ID NO: 389 - protein, 123 aa, Artificial Sequence
  Description of Artificial Sequence: Synthetic polypeptide
  VH5-51_IGHD5-18*01>3_IGHJ4*01 D106A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYAYFDYWGQGTLVTVSSAS

SEQ ID NO: 390 - protein, 123 aa, Artificial Sequence
  Description of Artificial Sequence: Synthetic polypeptide
  VH5-51_IGHD5-18*01>3_IGHJ4*01 G100L
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRLYSYGYDYFDYWGQGTLVTVSSAS

SEQ ID NO: 391 - protein, 123 aa, Artificial Sequence
  Description of Artificial Sequence: Synthetic polypeptide
  VH5-51_IGHD5-18*01>3_IGHJ4*01 G100D
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRDYSYGYDYFDYWGQGTLVTVSSAS

SEQ ID NO: 392 - protein, 123 aa, Artificial Sequence
  Description of Artificial Sequence: Synthetic polypeptide
  VH5-51_IGHD5-18*01>3_IGHJ4*01 G100T
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRTYSYGYDYFDYWGQGTLVTVSSAS

SEQ ID NO: 393 - protein, 123 aa, Artificial Sequence
  Description of Artificial Sequence: Synthetic polypeptide
  VH5-51_IGHD5-18*01>3_IGHJ4*01 G104D
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYDYDYFDYWGQGTLVTVSSAS

SEQ ID NO: 394 - protein, 123 aa, Artificial Sequence
  Description of Artificial Sequence: Synthetic polypeptide
  VH5-51_IGHD5-18*01>3_IGHJ4*01 G104L
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYLYDYFDYWGQGTLVTVSSAS

SEQ ID NO: 395 - protein, 123 aa, Artificial Sequence
  Description of Artificial Sequence: Synthetic polypeptide
  VH5-51_IGHD5-18*01>3_IGHJ4*01 G104P
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYPYDYFDYWGQGTLVTVSSAS

SEQ ID NO: 396 - protein, 123 aa, Artificial Sequence
  Description of Artificial Sequence: Synthetic polypeptide
  VH5-51_IGHD5-18*01>3_IGHJ4*01 G104R
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYRYDYFDYWGQGTLVTVSSAS

SEQ ID NO: 397 - protein, 123 aa, Artificial Sequence
  Description of Artificial Sequence: Synthetic polypeptide
  VH5-51_IGHD5-18*01>3_IGHJ4*01 G104M
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYMYDYFDYWGQGTLVTVSSAS

SEQ ID NO: 398 - protein, 123 aa, Artificial Sequence
  Description of Artificial Sequence: Synthetic polypeptide
  VH5-51_IGHD5-18*01>3_IGHJ4*01 G104K
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYKYDYFDYWGQGTLVTVSSAS

SEQ ID NO: 399 - protein, 123 aa, Artificial Sequence
  Description of Artificial Sequence: Synthetic polypeptide
  VH5-51_IGHD5-18*01>3_IGHJ4*01 G104S
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYSYDYFDYWGQGTLVTVSSAS

SEQ ID NO: 400 - protein, 123 aa, Artificial Sequence
  Description of Artificial Sequence: Synthetic polypeptide
  VH5-51_IGHD5-18*01>3_IGHJ4*01 G104R/Y101H
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGHSYRYDYFDYWGQGTLVTVSSAS

SEQ ID NO: 401 - protein, 123 aa, Artificial Sequence
  Description of Artificial Sequence: Synthetic polypeptide
  VH5-51_IGHD5-18*01>3_IGHJ4*01 G100K/G104T G24A
EVQLVQSGAEVKKPGESLKISCKASGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 402 - protein, 123 aa, Artificial Sequence
  Description of Artificial Sequence: Synthetic polypeptide
  VH5-51_IGHD5-18*01>3_IGHJ4*01 G100K/G104T I34A
EVQLVQSGAEVKKPGESLKISCKGSGYSFTSYWAGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 403 - protein, 123 aa, Artificial Sequence
  Description of Artificial Sequence: Synthetic polypeptide
  VH5-51_IGHD5-18*01>3_IGHJ4*01 G100K/G104T G35A
EVQLVQSGAEVKKPGESLKISCKGSGYSFTSYWIAWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 404 - protein, 123 aa, Artificial Sequence
  Description of Artificial Sequence: Synthetic polypeptide
  VH5-51_IGHD5-18*01>3_IGHJ4*01 G100K/G104T S28A
EVQLVQSGAEVKKPGESLKISCKGSGYAFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 405 - protein, 123 aa, Artificial Sequence
  Description of Artificial Sequence: Synthetic polypeptide
  VH5-51_IGHD5-18*01>3_IGHJ4*01 G100K/G104T F29A
EVQLVQSGAEVKKPGESLKISCKGSGYSATSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 406 - protein, 123 aa, Artificial Sequence
  Description of Artificial Sequence: Synthetic polypeptide
  VH5-51_IGHD5-18*01>3_IGHJ4*01 G100K/G104T T30A
EVQLVQSGAEVKKPGESLKISCKGSGYSFASYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 407 - protein, 123 aa, Artificial Sequence
  Description of Artificial Sequence: Synthetic polypeptide
  VH5-51_IGHD5-18*01>3_IGHJ4*01 G100K/G104T W33A
EVQLVQSGAEVKKPGESLKISCKGSGYSFTSYAIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 408 - protein, 123 aa, Artificial Sequence
  Description of Artificial Sequence: Synthetic polypeptide
  VH5-51_IGHD5-18*01>3_IGHJ4*01 G100K/G104T G24L
EVQLVQSGAEVKKPGESLKISCKLSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 409 - protein, 123 aa, Artificial Sequence
  Description of Artificial Sequence: Synthetic polypeptide
  VH5-51_IGHD5-18*01>3_IGHJ4*01 G100K/G104T S84I
EVQLVQSGAEVKKPGESLKISCKGSGYSFTSYWIGWVRQMPGKGLEWMGIIYPGDSDTRYSPSFQGQVTISADKSISTAYLQWISLKASDTAMYYCARRKYSYTYDYFDYWGQGTLVTVSSAS

SEQ ID NO: 410 - protein, 123 aa, Artificial Sequence
  Description of Artificial Sequence: Synthetic polypeptide
  VH5-51_IGHD5-18*01>3_IGHJ4*01 G100K/G104T G24R
EVQLVQSGAEVKKPGESLKISCKRSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 411 - protein, 123 aa, Artificial Sequence
  Description of Artificial Sequence: Synthetic polypeptide
  VH5-51_IGHD5-18*01>3_IGHJ4*01 G100K/G104T S28R
EVQLVQSGAEVKKPGESLKISCKGSGYRFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 412 - protein, 123 aa, Artificial Sequence
  Description of Artificial Sequence: Synthetic polypeptide
  VH5-51_IGHD5-18*01>3_IGHJ4*01 G100K/G104T S28K
EVQLVQSGAEVKKPGESLKISCKGSGYKFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 413 - protein, 123 aa, Artificial Sequence
  Description of Artificial Sequence: Synthetic polypeptide
  VH5-51_IGHD5-18*01>3_IGHJ4*01 G100K/G104T S28N
EVQLVQSGAEVKKPGESLKISCKGSGYNFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 414 - protein, 123 aa, Artificial Sequence
  Description of Artificial Sequence: Synthetic polypeptide
  VH5-51_IGHD5-18*01>3_IGHJ4*01 G100K/G104T G35T
EVQLVQSGAEVKKPGESLKISCKGSGYSFTSYWITWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 415 - protein, 123 aa, Artificial Sequence; identical to SEQ ID NO: 403
  Description of Artificial Sequence: Synthetic polypeptide
  VH5-51_IGHD5-18*01>3_IGHJ4*01 G100K/G104T G35A

SEQ ID NO: 416 - protein, 123 aa, Artificial Sequence
  Description of Artificial Sequence: Synthetic polypeptide
  VH5-51_IGHD5-18*01>3_IGHJ4*01 G100K/G104T G35V
EVQLVQSGAEVKKPGESLKISCKGSGYSFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 417 - protein, 123 aa, Artificial Sequence
  Description of Artificial Sequence: Synthetic polypeptide
  VH5-51_IGHD5-18*01>3_IGHJ4*01 G100K/G104T G24L/S28R/G35V
EVQLVQSGAEVKKPGESLKISCKLSGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 418 - protein, 123 aa, Artificial Sequence
  Description of Artificial Sequence: Synthetic polypeptide
  VH5-51_IGHD5-18*01>3_IGHJ4*01 G100K/G104T D57A
EVQLVQSGAEVKKPGESLKISCKGSGYSFTSYWIGWVRQMPGKGLEWMGIIYPGDSATRYSPSFQGQVTISADKSISTAYLQWSSLKASDTAMYYCARRKYSYTYDYFDYWGQGTLVTVSSAS

SEQ ID NO: 419 - protein, 123 aa, Artificial Sequence
  Description of Artificial Sequence: Synthetic polypeptide
  VH5-51_IGHD5-18*01>3_IGHJ4*01 G100K/G104T I50A
EVQLVQSGAEVKKPGESLKISCKGSGYSFTSYWIGWVRQMPGKGLEWMGAIYPGDSDTRYSPSFQGQVTISADKSISTAYLQWSSLKASDTAMYYCARRKYSYTYDYFDYWGQGTLVTVSSAS

SEQ ID NO: 420 - protein, 123 aa, Artificial Sequence
  Description of Artificial Sequence: Synthetic polypeptide
  VH5-51_IGHD5-18*01>3_IGHJ4*01 G100K/G104T I51A
EVQLVQSGAEVKKPGESLKISCKGSGYSFTSYWIGWVRQMPGKGLEWMGIAYPGDSDTRYSPSFQGQVTISADKSISTAYLQWSSLKASDTAMYYCARRKYSYTYDYFDYWGQGTLVTVSSAS

SEQ ID NO: 421 - protein, 123 aa, Artificial Sequence
  Description of Artificial Sequence: Synthetic polypeptide
  VH5-51_IGHD5-18*01>3_IGHJ4*01 G100K/G104T Y52A
EVQLVQSGAEVKKPGESLKISCKGSGYSFTSYWIGWVRQMPGKGLEWMGIIAPGDSDTRYSPSFQGQVTISADKSISTAYLQWSSLKASDTAMYYCARRKYSYTYDYFDYWGQGTLVTVSSAS

SEQ ID NO: 422 - protein, 123 aa, Artificial Sequence
  Description of Artificial Sequence: Synthetic polypeptide
  VH5-51_IGHD5-18*01>3_IGHJ4*01 G100K/G104T P53A
EVQLVQSGAEVKKPGESLKISCKGSGYSFTSYWIGWVRQMPGKGLEWMGIIYAGDSDTRYSPSFQGQVTISADKSISTAYLQWSSLKASDTAMYYCARRKYSYTYDYFDYWGQGTLVTVSSAS

SEQ ID NO: 423 - protein, 123 aa, Artificial Sequence
  Description of Artificial Sequence: Synthetic polypeptide
  VH5-51_IGHD5-18*01>3_IGHJ4*01 G100K/G104T D55A
EVQLVQSGAEVKKPGESLKISCKGSGYSFTSYWIGWVRQMPGKGLEWMGIIYPGASDTRYSPSFQGQVTISADKSISTAYLQWSSLKASDTAMYYCARRKYSYTYDYFDYWGQGTLVTVSSAS

SEQ ID NO: 424 - protein, 123 aa, Artificial Sequence
  Description of Artificial Sequence: Synthetic polypeptide
  VH5-51_IGHD5-18*01>3_IGHJ4*01 G100K/G104T T58D
EVQLVQSGAEVKKPGESLKISCKGSGYSFTSYWIGWVRQMPGKGLEWMGIIYPGDSDDRYSPSFQGQVTISADKSISTAYLQWSSLKASDTAMYYCARRKYSYTYDYFDYWGQGTLVTVSSAS

SEQ ID NO: 425 - protein, 123 aa, Artificial Sequence
  Description of Artificial Sequence: Synthetic polypeptide
  VH5-51_IGHD5-18*01>3_IGHJ4*01 G100K/G104T T58A
EVQLVQSGAEVKKPGESLKISCKGSGYSFTSYWIGWVRQMPGKGLEWMGIIYPGDSDARYSPSFQGQVTISADKSISTAYLQWSSLKASDTAMYYCARRKYSYTYDYFDYWGQGTLVTVSSAS

SEQ ID NO: 426 - protein, 123 aa, Artificial Sequence
  Description of Artificial Sequence: Synthetic polypeptide
  VH5-51_IGHD5-18*01>3_IGHJ4*01 G100K/G104T S56G
EVQLVQSGAEVKKPGESLKISCKGSGYSFTSYWIGWVRQMPGKGLEWMGIIYPGDGDTRYSPSFQGQVTISADKSISTAYLQWSSLKASDTAMYYCARRKYSYTYDYFDYWGQGTLVTVSSAS

SEQ ID NO: 427 - protein, 123 aa, Artificial Sequence
  Description of Artificial Sequence: Synthetic polypeptide
  VH5-51_IGHD5-18*01>3_IGHJ4*01 G100K/G104T S84V
EVQLVQSGAEVKKPGESLKISCKGSGYSFTSYWIGWVRQMPGKGLEWMGIIYPGDSDTRYSPSFQGQVTISADKSISTAYLQWVSLKASDTAMYYCARRKYSYTYDYFDYWGQGTLVTVSSAS

SEQ ID NO: 428 - protein, 123 aa, Artificial Sequence
  Description of Artificial Sequence: Synthetic polypeptide
  VH5-51_IGHD5-18*01>3_IGHJ4*01 G100K/G104T S84L
EVQLVQSGAEVKKPGESLKISCKGSGYSFTSYWIGWVRQMPGKGLEWMGIIYPGDSDTRYSPSFQGQVTISADKSISTAYLQWLSLKASDTAMYYCARRKYSYTYDYFDYWGQGTLVTVSSAS

SEQ ID NO: 429 - protein, 123 aa, Artificial Sequence
  Description of Artificial Sequence: Synthetic polypeptide
  VH5-51_IGHD5-18*01>3_IGHJ4*01 G100K/G104T D109A
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRKYSYTYDYFAYWGQGTLVTVSSAS

SEQ ID NO: 430 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 431 - protein, 123 aa, Artificial Sequence
  Description of Artificial Sequence: Synthetic polypeptide
  VH5-51_IGHD5-18*01>3_IGHJ4*01 G100K/G104T G24A/S28R/G35V
EVQLVQSGAEVKKPGESLKISCKASGYRFTSYWIVWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 432 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y105H
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTHDYFDYWGQGTLVTVSSAS

SEQ ID NO: 433 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y105N
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTNDYFDYWGQGTLVTVSSAS

SEQ ID NO: 434 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V Y107F
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDFFDYWGQGTLVTVSSAS

SEQ ID NO: 435 - protein, 123 aa, Artificial Sequence
  Description of Artificial Sequence: Synthetic polypeptide
  VH5-51_IGHD5-18*01>3_IGHJ4*01 G100K/G104T G24T/S28R/G35V D109Q
EVQLVQSGAEVKKPGESLKISCKTSGYRFTSYWIVWVRQMPGKGLEWMGIIYPGDSDTRYSPSFQGQVTISADKSISTAYLQWSSLKASDTAMYYCARRKYSYTYDYFQYWGQGTLVTVSSAS

SEQ ID NO: 436 - protein, 103 aa, Artificial Sequence
  Description of Artificial Sequence: Synthetic polypeptide
  VH5-51_IGHD5-18*01>3_IGHJ4*01 G104STOP
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSY

SEQ ID NO: 437 - protein, 123 aa, Artificial Sequence
  Description of Artificial Sequence: Synthetic polypeptide
  VH5-51_IGHD5-18*01>3_IGHJ4*01 G104X
  misc_feature (104)..(104): Xaa is an unknown amino acid residue
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYXYDYFDYWGQGTLVTVSSAS

SEQ ID NO: 438 - protein, 123 aa, Artificial Sequence
  Description of Artificial Sequence: Synthetic polypeptide
  VH5-51_IGHD5-18*01>3_IGHJ4*01 G100K/G104T G24X
  misc_feature (24)..(24): Xaa is an unknown amino acid residue
EVQLVQSGAEVKKPGESLKISCKXSGYSFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 439 - protein, 123 aa, Artificial Sequence; identical to SEQ ID NO: 438
  Description of Artificial Sequence: Synthetic polypeptide
  VH5-51_IGHD5-18*01>3_IGHJ4*01 G100K/G104T G24S/T
  MOD_RES (24)..(24): Ser or Thr

SEQ ID NO: 440 - protein, 123 aa, Artificial Sequence; identical to SEQ ID NO: 438
  Description of Artificial Sequence: Synthetic polypeptide
  VH5-51_IGHD5-18*01>3_IGHJ4*01 G100K/G104T G24L/G
  MOD_RES (24)..(24): Leu or Gly

SEQ ID NO: 441 - protein, 123 aa, Artificial Sequence
  Description of Artificial Sequence: Synthetic polypeptide
  VH5-51_IGHD5-18*01>3_IGHJ4*01 G100K/G104T S28X
  misc_feature (28)..(28): Xaa is an unknown amino acid residue
EVQLVQSGAEVKKPGESLKISCKGSGYXFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 442 - protein, 123 aa, Artificial Sequence
  Description of Artificial Sequence: Synthetic polypeptide
  VH5-51_IGHD5-18*01>3_IGHJ4*01 G100K/G104T G35X
  misc_feature (35)..(35): Xaa is an unknown amino acid residue
EVQLVQSGAEVKKPGESLKISCKGSGYSFTSYWIXWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 443 - protein, 123 aa, Artificial Sequence
  Description of Artificial Sequence: Synthetic polypeptide
  VH5-51_IGHD5-18*01>3_IGHJ4*01 G100K/G104T T58D/K
  MOD_RES (58)..(58): Thr or Lys
EVQLVQSGAEVKKPGESLKISCKGSGYSFTSYWIGWVRQMPGKGLEWMGIIYPGDSDXRYSPSFQGQVTISADKSISTAYLQWSSLKASDTAMYYCARRKYSYTYDYFDYWGQGTLVTVSSAS

SEQ ID NO: 444 - protein, 123 aa, Artificial Sequence; identical to SEQ ID NO: 443
  Description of Artificial Sequence: Synthetic polypeptide
  VH5-51_IGHD5-18*01>3_IGHJ4*01 G100K/G104T T58X
  misc_feature (58)..(58): Xaa is an unknown amino acid residue

SEQ ID NO: 445 - protein, 123 aa, Artificial Sequence; identical to SEQ ID NO: 381
  Description of Artificial Sequence: Synthetic polypeptide
  VH5-51_IGHD5-18*01>3_IGHJ4*01 G100K/G104T S56X

SEQ ID NO: 446 - protein, 111 aa, Artificial Sequence
  Description of Artificial Sequence: Synthetic polypeptide
  V3-4_IGLJ1*01 V91A
QTVVTQEPSFSVSPGGTVTLTCGLSSGSVSTSYYPSWYQQTPGQAPRTLIYSTNTRSSGVPDRFSGSILGNKAALTITGAQADDESDYYCALYMGSGISYVFGTGTKVTVL

SEQ ID NO: 447 - protein, 111 aa, Artificial Sequence
  Description of Artificial Sequence: Synthetic polypeptide
  V3-4_IGLJ1*01 L92A
QTVVTQEPSFSVSPGGTVTLTCGLSSGSVSTSYYPSWYQQTPGQAPRTLIYSTNTRSSGVPDRFSGSILGNKAALTITGAQADDESDYYCVAYMGSGISYVFGTGTKVTVL

SEQ ID NO: 448 - protein, 111 aa, Artificial Sequence
  Description of Artificial Sequence: Synthetic polypeptide
  V3-4_IGLJ1*01 Y93A
QTVVTQEPSFSVSPGGTVTLTCGLSSGSVSTSYYPSWYQQTPGQAPRTLIYSTNTRSSGVPDRFSGSILGNKAALTITGAQADDESDYYCVLAMGSGISYVFGTGTKVTVL

SEQ ID NO: 449 - protein, 111 aa, Artificial Sequence
  Description of Artificial Sequence: Synthetic polypeptide
  V3-4_IGLJ1*01 M94A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYAGSGISYVFGTGTKVTVL

SEQ ID NO: 450 - protein, 111 aa, Artificial Sequence
  Description of Artificial Sequence: Synthetic polypeptide
  V3-4_IGLJ1*01 G95A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMASGISYVFGTGTKVTVL

SEQ ID NO: 451 - protein, 111 aa, Artificial Sequence
  Description of Artificial Sequence: Synthetic polypeptide
  V3-4_IGLJ1*01 G97A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSAISYVFGTGTKVTVL

SEQ ID NO: 452 - protein, 111 aa, Artificial Sequence
  Description of Artificial Sequence: Synthetic polypeptide
  V3-4_IGLJ1*01 S96A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGAGISYVFGTGTKVTVL

SEQ ID NO: 453 - protein, 111 aa, Artificial Sequence
  Description of Artificial Sequence: Synthetic polypeptide
  V3-4_IGLJ1*01 I98A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGASYVFGTGTKVTVL

SEQ ID NO: 454 - protein, 111 aa, Artificial Sequence
  Description of Artificial Sequence: Synthetic polypeptide
  V3-4_IGLJ1*01 S99A
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGIAYVFGTGTKVTVL

SEQ ID NO: 455 - protein, 111 aa, Artificial Sequence
  Description of Artificial Sequence: Synthetic polypeptide
  V3-4_IGLJ1*01 V91P
QTVVTQEPSFSVSPGGTVTLTCGLSSGSVSTSYYPSWYQQTPGQAPRTLIYSTNTRSSGVPDRFSGSILGNKAALTITGAQADDESDYYCPLYMGSGISYVFGTGTKVTVL

SEQ ID NO: 456 - protein, 111 aa, Artificial Sequence
  Description of Artificial Sequence: Synthetic polypeptide
  V3-4_IGLJ1*01 V91T
QTVVTQEPSFSVSPGGTVTLTCGLSSGSVSTSYYPSWYQQTPGQAPRTLIYSTNTRSSGVPDRFSGSILGNKAALTITGAQADDESDYYCTLYMGSGISYVFGTGTKVTVL

SEQ ID NO: 457 - protein, 111 aa, Artificial Sequence
  Description of Artificial Sequence: Synthetic polypeptide
  V3-4_IGLJ1*01 V91S
QTVVTQEPSFSVSPGGTVTLTCGLSSGSVSTSYYPSWYQQTPGQAPRTLIYSTNTRSSGVPDRFSGSILGNKAALTITGAQADDESDYYCSLYMGSGISYVFGTGTKVTVL

SEQ ID NO: 458 - protein, 111 aa, Artificial Sequence
  Description of Artificial Sequence: Synthetic polypeptide
  V3-4_IGLJ1*01 V91L
QTVVTQEPSFSVSPGGTVTLTCGLSSGSVSTSYYPSWYQQTPGQAPRTLIYSTNTRSSGVPDRFSGSILGNKAALTITGAQADDESDYYCLLYMGSGISYVFGTGTKVTVL

SEQ ID NO: 459 - protein, 111 aa, Artificial Sequence
  Description of Artificial Sequence: Synthetic polypeptide
  V3-4_IGLJ1*01 V91R
QTVVTQEPSFSVSPGGTVTLTCGLSSGSVSTSYYPSWYQQTPGQAPRTLIYSTNTRSSGVPDRFSGSILGNKAALTITGAQADDESDYYCRLYMGSGISYVFGTGTKVTVL

SEQ ID NO: 460 - protein, 111 aa, Artificial Sequence
  Description of Artificial Sequence: Synthetic polypeptide
  V3-4_IGLJ1*01 V91C
QTVVTQEPSFSVSPGGTVTLTCGLSSGSVSTSYYPSWYQQTPGQAPRTLIYSTNTRSSGVPDRFSGSILGNKAALTITGAQADDESDYYCCLYMGSGISYVFGTGTKVTVL

SEQ ID NO: 461 - protein, 111 aa, Artificial Sequence
  Description of Artificial Sequence: Synthetic polypeptide
  V3-4_IGLJ1*01 V91E
QTVVTQEPSFSVSPGGTVTLTCGLSSGSVSTSYYPSWYQQTPGQAPRTLIYSTNTRSSGVPDRFSGSILGNKAALTITGAQADDESDYYCELYMGSGISYVFGTGTKVTVL

SEQ ID NO: 462 - protein, 111 aa, Artificial Sequence
  Description of Artificial Sequence: Synthetic polypeptide
  V3-4_IGLJ1*01 V91W
QTVVTQEPSFSVSPGGTVTLTCGLSSGSVSTSYYPSWYQQTPGQAPRTLIYSTNTRSSGVPDRFSGSILGNKAALTITGAQADDESDYYCWLYMGSGISYVFGTGTKVTVL

SEQ ID NO: 463 - protein, 111 aa, Artificial Sequence
  Description of Artificial Sequence: Synthetic polypeptide
  V3-4_IGLJ1*01 V91N
QTVVTQEPSFSVSPGGTVTLTCGLSSGSVSTSYYPSWYQQTPGQAPRTLIYSTNTRSSGVPDRFSGSILGNKAALTITGAQADDESDYYCNLYMGSGISYVFGTGTKVTVL

SEQ ID NO: 464 - protein, 111 aa, Artificial Sequence
  Description of Artificial Sequence: Synthetic polypeptide
  V3-4_IGLJ1*01 V91I
QTVVTQEPSFSVSPGGTVTLTCGLSSGSVSTSYYPSWYQQTPGQAPRTLIYSTNTRSSGVPDRFSGSILGNKAALTITGAQADDESDYYCILYMGSGISYVFGTGTKVTVL

SEQ ID NO: 465 - protein, 111 aa, Artificial Sequence
  Description of Artificial Sequence: Synthetic polypeptide
  V3-4_IGLJ1*01 V91G
QTVVTQEPSFSVSPGGTVTLTCGLSSGSVSTSYYPSWYQQTPGQAPRTLIYSTNTRSSGVPDRFSGSILGNKAALTITGAQADDESDYYCGLYMGSGISYVFGTGTKVTVL

SEQ ID NO: 466 - protein, 111 aa, Artificial Sequence
  Description of Artificial Sequence: Synthetic polypeptide
  V3-4_IGLJ1*01 V91H
QTVVTQEPSFSVSPGGTVTLTCGLSSGSVSTSYYPSWYQQTPGQAPRTLIYSTNTRSSGVPDRFSGSILGNKAALTITGAQADDESDYYCHLYMGSGISYVFGTGTKVTVL

SEQ ID NO: 467 - protein, 111 aa, Artificial Sequence
  Description of Artificial Sequence: Synthetic polypeptide
  V3-4_IGLJ1*01 M94E
QTVVTQEPSFSVSPGGTVTLTCGLSSGSVSTSYYPSWYQQTPGQAPRTLIYSTNTRSSGVPDRFSGSILGNKAALTITGAQADDESDYYCVLYEGSGISYVFGTGTKVTVL

SEQ ID NO: 468 - protein, 111 aa, Artificial Sequence
  Description of Artificial Sequence: Synthetic polypeptide
  V3-4_IGLJ1*01 M94S
QTVVTQEPSFSVSPGGTVTLTCGLSSGSVSTSYYPSWYQQTPGQAPRTLIYSTNTRSSGVPDRFSGSILGNKAALTITGAQADDESDYYCVLYSGSGISYVFGTGTKVTVL

SEQ ID NO: 469 - protein, 111 aa, Artificial Sequence
  Description of Artificial Sequence: Synthetic polypeptide
  V3-4_IGLJ1*01 M94G
QTVVTQEPSFSVSPGGTVTLTCGLSSGSVSTSYYPSWYQQTPGQAPRTLIYSTNTRSSGVPDRFSGSILGNKAALTITGAQADDESDYYCVLYGGSGISYVFGTGTKVTVL

SEQ ID NO: 470 - protein, 111 aa, Artificial Sequence
  Description of Artificial Sequence: Synthetic polypeptide
  V3-4_IGLJ1*01 M94L
QTVVTQEPSFSVSPGGTVTLTCGLSSGSVSTSYYPSWYQQTPGQAPRTLIYSTNTRSSGVPDRFSGSILGNKAALTITGAQADDESDYYCVLYLGSGISYVFGTGTKVTVL

SEQ ID NO: 471 - protein, 111 aa, Artificial Sequence
  Description of Artificial Sequence: Synthetic polypeptide
  V3-4_IGLJ1*01 M94P
QTVVTQEPSFSVSPGGTVTLTCGLSSGSVSTSYYPSWYQQTPGQAPRTLIYSTNTRSSGVPDRFSGSILGNKAALTITGAQADDESDYYCVLYPGSGISYVFGTGTKVTVL

SEQ ID NO: 472 - protein, 111 aa, Artificial Sequence
  Description of Artificial Sequence: Synthetic polypeptide
  V3-4_IGLJ1*01 M94V
QTVVTQEPSFSVSPGGTVTLTCGLSSGSVSTSYYPSWYQQTPGQAPRTLIYSTNTRSSGVPDRFSGSILGNKAALTITGAQADDESDYYCVLYVGSGISYVFGTGTKVTVL

SEQ ID NO: 473 - protein, 111 aa, Artificial Sequence
  Description of Artificial Sequence: Synthetic polypeptide
  V3-4_IGLJ1*01 M94D
QTVVTQEPSFSVSPGGTVTLTCGLSSGSVSTSYYPSWYQQTPGQAPRTLIYSTNTRSSGVPDRFSGSILGNKAALTITGAQADDESDYYCVLYDGSGISYVFGTGTKVTVL

SEQ ID NO: 474 - protein, 111 aa, Artificial Sequence
  Description of Artificial Sequence: Synthetic polypeptide
  V3-4_IGLJ1*01 M94R
QTVVTQEPSFSVSPGGTVTLTCGLSSGSVSTSYYPSWYQQTPGQAPRTLIYSTNTRSSGVPDRFSGSILGNKAALTITGAQADDESDYYCVLYRGSGISYVFGTGTKVTVL

SEQ ID NO: 475 - protein, 111 aa, Artificial Sequence
  Description of Artificial Sequence: Synthetic polypeptide
  V3-4_IGLJ1*01 M94N
QTVVTQEPSFSVSPGGTVTLTCGLSSGSVSTSYYPSWYQQTPGQAPRTLIYSTNTRSSGVPDRFSGSILGNKAALTITGAQADDESDYYCVLYNGSGISYVFGTGTKVTVL

SEQ ID NO: 476 - protein, 111 aa, Artificial Sequence
  Description of Artificial Sequence: Synthetic polypeptide
  V3-4_IGLJ1*01 M94T
QTVVTQEPSFSVSPGGTVTLTCGLSSGSVSTSYYPSWYQQTPGQAPRTLIYSTNTRSSGVPDRFSGSILGNKAALTITGAQADDESDYYCVLYTGSGISYVFGTGTKVTVL

SEQ ID NO: 477 - protein, 111 aa, Artificial Sequence
  Description of Artificial Sequence: Synthetic polypeptide
  V3-4_IGLJ1*01 M94F
QTVVTQEPSFSVSPGGTVTLTCGLSSGSVSTSYYPSWYQQTPGQAPRTLIYSTNTRSSGVPDRFSGSILGNKAALTITGAQADDESDYYCVLYFGSGISYVFGTGTKVTVL

SEQ ID NO: 478 - protein, 111 aa, Artificial Sequence
  Description of Artificial Sequence: Synthetic polypeptide
  V3-4_IGLJ1*01 S96W
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGWGISYVFGTGTKVTVL

SEQ ID NO: 479 - protein, 111 aa, Artificial Sequence
  Description of Artificial Sequence: Synthetic polypeptide
  V3-4_IGLJ1*01 S96G
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGGGISYVFGTGTKVTVL

SEQ ID NO: 480 - protein, 111 aa, Artificial Sequence
  Description of Artificial Sequence: Synthetic polypeptide
  V3-4_IGLJ1*01 S96P
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGPGISYVFGTGTKVTVL

SEQ ID NO: 481 - protein, 111 aa, Artificial Sequence
  Description of Artificial Sequence: Synthetic polypeptide
  V3-4_IGLJ1*01 S96R
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGRGISYVFGTGTKVTVL

SEQ ID NO: 482 - protein, 111 aa, Artificial Sequence
  Description of Artificial Sequence: Synthetic polypeptide
  V3-4_IGLJ1*01 S96L
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGLGISYVFGTGTKVTVL

SEQ ID NO: 483 - protein, 111 aa, Artificial Sequence
  Description of Artificial Sequence: Synthetic polypeptide
  V3-4_IGLJ1*01 S96M
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGMGISYVFGTGTKVTVL

SEQ ID NO: 484 - protein, 111 aa, Artificial Sequence
  Description of Artificial Sequence: Synthetic polypeptide
  V3-4_IGLJ1*01 S96E
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGEGISYVFGTGTKVTVL

SEQ ID NO: 485 - protein, 111 aa, Artificial Sequence
  Description of Artificial Sequence: Synthetic polypeptide
  V3-4_IGLJ1*01 S96V
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGVGISYVFGTGTKVTVL

SEQ ID NO: 486 - protein, 111 aa, Artificial Sequence
  Description of Artificial Sequence: Synthetic polypeptide
  V3-4_IGLJ1*01 M94R/S96M
QTVVTQEPSFSVSPGGTVTLTCGLSSGSVSTSYYPSWYQQTPGQAPRTLIYSTNTRSSGVPDRFSGSILGNKAALTITGAQADDESDYYCVLYRGMGISYVFGTGTKVTVL

SEQ ID NO: 487 - protein, 111 aa, Artificial Sequence
  Description of Artificial Sequence: Synthetic polypeptide
  V3-4_IGLJ1*01 L24A
QTVVTQEPSFSVSPGGTVTLTCGASSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 488 - protein, 111 aa, Artificial Sequence
  Description of Artificial Sequence: Synthetic polypeptide
  V3-4_IGLJ1*01 S26A
QTVVTQEPSFSVSPGGTVTLTCGLSAGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 489 - protein, 111 aa, Artificial Sequence
  Description of Artificial Sequence: Synthetic polypeptide
  V3-4_IGLJ1*01 G27A
QTVVTQEPSFSVSPGGTVTLTCGLSSASVSTSYYPSWYQQTPGQAPRTLIYSTNTRSSGVPDRFSGSILGNKAALTITGAQADDESDYYCVLYMGSGISYVFGTGTKVTVL

SEQ ID NO: 490 - protein, 111 aa, Artificial Sequence
  Description of Artificial Sequence: Synthetic polypeptide
  V3-4_IGLJ1*01 S28A
QTVVTQEPSFSVSPGGTVTLTCGLSSGAVSTSYYPSWYQQTPGQAPRTLIYSTNTRSSGVPDRFSGSILGNKAALTITGAQADDESDYYCVLYMGSGISYVFGTGTKVTVL

SEQ ID NO: 491 - protein, 111 aa, Artificial Sequence
  Description of Artificial Sequence: Synthetic polypeptide
  V3-4_IGLJ1*01 V29A
QTVVTQEPSFSVSPGGTVTLTCGLSSGSASTSYYPSWYQQTPGQAPRTLIYSTNTRSSGVPDRFSGSILGNKAALTITGAQADDESDYYCVLYMGSGISYVFGTGTKVTVL

SEQ ID NO: 492 - protein, 111 aa, Artificial Sequence
  Description of Artificial Sequence: Synthetic polypeptide
  V3-4_IGLJ1*01 S30A
QTVVTQEPSFSVSPGGTVTLTCGLSSGSVATSYYPSWYQQTPGQAPRTLIYSTNTRSSGVPDRFSGSILGNKAALTITGAQADDESDYYCVLYMGSGISYVFGTGTKVTVL

SEQ ID NO: 493 - protein, 111 aa, Artificial Sequence
  Description of Artificial Sequence: Synthetic polypeptide
  V3-4_IGLJ1*01 T31A
QTVVTQEPSFSVSPGGTVTLTCGLSSGSVSASYYPSWYQQTPGQAPRTLIYSTNTRSSGVPDRFSGSILGNKAALTITGAQADDESDYYCVLYMGSGISYVFGTGTKVTVL

SEQ ID NO: 494 - protein, 111 aa, Artificial Sequence
  Description of Artificial Sequence: Synthetic polypeptide
  V3-4_IGLJ1*01 S32A
QTVVTQEPSFSVSPGGTVTLTCGLSSGSVSTAYYPSWYQQTPGQAPRTLIYSTNTRSSGVPDRFSGSILGNKAALTITGAQADDESDYYCVLYMGSGISYVFGTGTKVTVL

SEQ ID NO: 495 - protein, 111 aa, Artificial Sequence
  Description of Artificial Sequence: Synthetic polypeptide
  V3-4_IGLJ1*01 Y33A
QTVVTQEPSFSVSPGGTVTLTCGLSSGSVSTSAYPSWYQQTPGQAPRTLIYSTNTRSSGVPDRFSGSILGNKAALTITGAQADDESDYYCVLYMGSGISYVFGTGTKVTVL

SEQ ID NO: 496 - protein, 111 aa, Artificial Sequence
  Description of Artificial Sequence: Synthetic polypeptide
  V3-4_IGLJ1*01 Y34A
QTVVTQEPSFSVSPGGTVTLTCGLSSGSVSTSYAPSWYQQTPGQAPRTLIYSTNTRSSGVPDRFSGSILGNKAALTITGAQADDESDYYCVLYMGSGISYVFGTGTKVTVL

SEQ ID NO: 497 - protein, 111 aa, Artificial Sequence
  Description of Artificial Sequence: Synthetic polypeptide
  V3-4_IGLJ1*01 P35A
QTVVTQEPSFSVSPGGTVTLTCGLSSGSVSTSYYASWYQQTPGQAPRTLIYSTNTRSSGVPDRFSGSILGNKAALTITGAQADDESDYYCVLYMGSGISYVFGTGTKVTVL

SEQ ID NO: 498 - protein, 111 aa, Artificial Sequence
  Description of Artificial Sequence: Synthetic polypeptide
  V3-4_IGLJ1*01 S36A
QTVVTQEPSFSVSPGGTVTLTCGLSSGSVSTSYYPAWYQQTPGQAPRTLIYSTNTRSSGVPDRFSGSILGNKAALTITGAQADDESDYYCVLYMGSGISYVFGTGTKVTVL

SEQ ID NO: 499 - protein, 111 aa, Artificial Sequence
  Description of Artificial Sequence: Synthetic polypeptide
  V3-4_IGLJ1*01 G23A
QTVVTQEPSFSVSPGGTVTLTCALSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 500 - protein, 111 aa, Artificial Sequence
  Description of Artificial Sequence: Synthetic polypeptide
  V3-4_IGLJ1*01 S25A
QTVVTQEPSFSVSPGGTVTLTCGLASGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 501 - protein, 111 aa, Artificial Sequence
  Description of Artificial Sequence: Synthetic polypeptide
  V3-4_IGLJ1*01 G23R
QTVVTQEPSFSVSPGGTVTLTCRLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 502 - protein, 111 aa, Artificial Sequence
  Description of Artificial Sequence: Synthetic polypeptide
  V3-4_IGLJ1*01 G23L
QTVVTQEPSFSVSPGGTVTLTCLLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 503 - protein, 111 aa, Artificial Sequence
  Description of Artificial Sequence: Synthetic polypeptide
  V3-4_IGLJ1*01 S52A
QTVVTQEPSFSVSPGGTVTLTCGLSSGSVSTSYYPSWYQQTPGQAPRTLIYATNTRSSGVPDRFSGSILGNKAALTITGAQADDESDYYCVLYMGSGISYVFGTGTKVTVL

SEQ ID NO: 504 - protein, 111 aa, Artificial Sequence
  Description of Artificial Sequence: Synthetic polypeptide
  V3-4_IGLJ1*01 T53A
QTVVTQEPSFSVSPGGTVTLTCGLSSGSVSTSYYPSWYQQTPGQAPRTLIYSANTRSSGVPDRFSGSILGNKAALTITGAQADDESDYYCVLYMGSGISYVFGTGTKVTVL

SEQ ID NO: 505 - protein, 111 aa, Artificial Sequence
  Description of Artificial Sequence: Synthetic polypeptide
  V3-4_IGLJ1*01 N54A
QTVVTQEPSFSVSPGGTVTLTCGLSSGSVSTSYYPSWYQQTPGQAPRTLIYSTATRSSGVPDRFSGSILGNKAALTITGAQADDESDYYCVLYMGSGISYVFGTGTKVTVL

SEQ ID NO: 506 - protein, 111 aa, Artificial Sequence
  Description of Artificial Sequence: Synthetic polypeptide
  V3-4_IGLJ1*01 T55A
QTVVTQEPSFSVSPGGTVTLTCGLSSGSVSTSYYPSWYQQTPGQAPRTLIYSTNARSSGVPDRFSGSILGNKAALTITGAQADDESDYYCVLYMGSGISYVFGTGTKVTVL

SEQ ID NO: 507 - protein, 111 aa, Artificial Sequence
  Description of Artificial Sequence: Synthetic polypeptide
  V3-4_IGLJ1*01 R56A
QTVVTQEPSFSVSPGGTVTLTCGLSSGSVSTSYYPSWYQQTPGQAPRTLIYSTNTASSGVPDRFSGSILGNKAALTITGAQADDESDYYCVLYMGSGISYVFGTGTKVTVL

SEQ ID NO: 508 - protein, 111 aa, Artificial Sequence
  Description of Artificial Sequence: Synthetic polypeptide
  V3-4_IGLJ1*01 S57A
QTVVTQEPSFSVSPGGTVTLTCGLSSGSVSTSYYPSWYQQTPGQAPRTLIYSTNTRASGVPDRFSGSILGNKAALTITGAQADDESDYYCVLYMGSGISYVFGTGTKVTVL

SEQ ID NO: 509 - protein, 111 aa, Artificial Sequence
  Description of Artificial Sequence: Synthetic polypeptide
  V3-4_IGLJ1*01 S58A
QTVVTQEPSFSVSPGGTVTLTCGLSSGSVSTSYYPSWYQQTPGQAPRTLIYSTNTRSAGVPDRFSGSILGNKAALTITGAQADDESDYYCVLYMGSGISYVFGTGTKVTVL

SEQ ID NO: 510 - protein, 111 aa, Artificial Sequence
  Description of Artificial Sequence: Synthetic polypeptide
  V3-4_IGLJ1*01 S52G
QTVVTQEPSFSVSPGGTVTLTCGLSSGSVSTSYYPSWYQQTPGQAPRTLIYGTNTRSSGVPDRFSGSILGNKAALTITGAQADDESDYYCVLYMGSGISYVFGTGTKVTVL

SEQ ID NO: 511 - protein, 111 aa, Artificial Sequence
  Description of Artificial Sequence: Synthetic polypeptide
  V3-4_IGLJ1*01 S52C
QTVVTQEPSFSVSPGGTVTLTCGLSSGSVSTSYYPSWYQQTPGQAPRTLIYCTNTRSSGVPDRFSGSILGNKAALTITGAQADDESDYYCVLYMGSGISYVFGTGTKVTVL

SEQ ID NO: 512 - protein, 111 aa, Artificial Sequence
  Description of Artificial Sequence: Synthetic polypeptide
  V3-4_IGLJ1*01 S52R
QTVVTQEPSFSVSPGGTVTLTCGLSSGSVSTSYYPSWYQQTPGQAPRTLIYRTNTRSSGVPDRFSGSILGNKAALTITGAQADDESDYYCVLYMGSGISYVFGTGTKVTVL

SEQ ID NO: 513 - protein, 111 aa, Artificial Sequence
  Description of Artificial Sequence: Synthetic polypeptide
  V3-4_IGLJ1*01 R56I
QTVVTQEPSFSVSPGGTVTLTCGLSSGSVSTSYYPSWYQQTPGQAPRTLIYSTNTISSGVPDRFSGSILGNKAALTITGAQADDESDYYCVLYMGSGISYVFGTGTKVTVL

SEQ ID NO: 514 - protein, 111 aa, Artificial Sequence
  Description of Artificial Sequence: Synthetic polypeptide
  V3-4_IGLJ1*01 R56Y
QTVVTQEPSFSVSPGGTVTLTCGLSSGSVSTSYYPSWYQQTPGQAPRTLIYSTNTYSSGVPDRFSGSILGNKAALTITGAQADDESDYYCVLYMGSGISYVFGTGTKVTVL

SEQ ID NO: 515 - protein, 111 aa, Artificial Sequence
  Description of Artificial Sequence: Synthetic polypeptide
  V3-4_IGLJ1*01 R56D
QTVVTQEPSFSVSPGGTVTLTCGLSSGSVSTSYYPSWYQQTPGQAPRTLIYSTNTDSSGVPDRFSGSILGNKAALTITGAQADDESDYYCVLYMGSGISYVFGTGTKVTVL

SEQ ID NO: 516 - protein, 111 aa, Artificial Sequence
  Description of Artificial Sequence: Synthetic polypeptide
  V3-4_IGLJ1*01 R56G
QTVVTQEPSFSVSPGGTVTLTCGLSSGSVSTSYYPSWYQQTPGQAPRTLIYSTNTGSSGVPDRFSGSILGNKAALTITGAQADDESDYYCVLYMGSGISYVFGTGTKVTVL

SEQ ID NO: 517 - protein, 111 aa, Artificial Sequence
  Description of Artificial Sequence: Synthetic polypeptide
  V3-4_IGLJ1*01 R56S
QTVVTQEPSFSVSPGGTVTLTCGLSSGSVSTSYYPSWYQQTPGQAPRTLIYSTNTSSSGVPDRFSGSILGNKAALTITGAQADDESDYYCVLYMGSGISYVFGTGTKVTVL

SEQ ID NO: 518 - protein, 111 aa, Artificial Sequence
  Description of Artificial Sequence: Synthetic polypeptide
  V3-4_IGLJ1*01 T78S
QTVVTQEPSFSVSPGGTVTLTCGLSSGSVSTSYYPSWYQQTPGQAPRTLIYSTNTRSSGVPDRFSGSILGNKAALTISGAQADDESDYYCVLYMGSGISYVFGTGTKVTVL

SEQ ID NO: 519 - protein, 111 aa, Artificial Sequence
  Description of Artificial Sequence: Synthetic polypeptide
  V3-4_IGLJ1*01 T78E
QTVVTQEPSFSVSPGGTVTLTCGLSSGSVSTSYYPSWYQQTPGQAPRTLIYSTNTRSSGVPDRFSGSILGNKAALTIEGAQADDESDYYCVLYMGSGISYVFGTGTKVTVL

SEQ ID NO: 520 - protein, 111 aa, Artificial Sequence
  Description of Artificial Sequence: Synthetic polypeptide
  V3-4_IGLJ1*01 T78Y
QTVVTQEPSFSVSPGGTVTLTCGLSSGSVSTSYYPSWYQQTPGQAPRTLIYSTNTRSSGVPDRFSGSILGNKAALTIYGAQADDESDYYCVLYMGSGISYVFGTGTKVTVL

SEQ ID NO: 521 - protein, 111 aa, Artificial Sequence
  Description of Artificial Sequence: Synthetic polypeptide
  V3-4_IGLJ1*01 T78M
QTVVTQEPSFSVSPGGTVTLTCGLSSGSVSTSYYPSWYQQTPGQAPRTLIYSTNTRSSGVPDRFSGSILGNKAALTIMGAQADDESDYYCVLYMGSGISYVFGTGTKVTVL

SEQ ID NO: 522 - protein, 111 aa, Artificial Sequence
  Description of Artificial Sequence: Synthetic polypeptide
  V3-4_IGLJ1*01 T78L
QTVVTQEPSFSVSPGGTVTLTCGLSSGSVSTSYYPSWYQQTPGQAPRTLIYSTNTRSSGVPDRFSGSILGNKAALTILGAQADDESDYYCVLYMGSGISYVFGTGTKVTVL

SEQ ID NO: 523 - protein, 111 aa, Artificial Sequence
  Description of Artificial Sequence: Synthetic polypeptide
  V3-4_IGLJ1*01 T78K
QTVVTQEPSFSVSPGGTVTLTCGLSSGSVSTSYYPSWYQQTPGQAPRTLIYSTNTRSSGVPDRFSGSILGNKAALTIKGAQADDESDYYCVLYMGSGISYVFGTGTKVTVL

SEQ ID NO: 524 - protein, 111 aa, Artificial Sequence
  Description of Artificial Sequence: Synthetic polypeptide
  V3-4_IGLJ1*01 T78V
QTVVTQEPSFSVSPGGTVTLTCGLSSGSVSTSYYPSWYQQTPGQAPRTLIYSTNTRSSGVPDRFSGSILGNKAALTIVGAQADDESDYYCVLYMGSGISYVFGTGTKVTVL

SEQ ID NO: 525 - protein, 217 aa, Artificial Sequence
  Description of Artificial Sequence: Synthetic polypeptide
  V3-4_IGLJ1*01 G23A/N175K
QTVVTQEPSFSVSPGGTVTLTCALSSGSVSTSYYPSWYQQTPGQAPRTLIYSTNTRSSGVPDRFSGSILGNKAALTITGAQADDESDYYCVLYMGSGISYVFGTGTKVTVLGQPKAAPSVTLFPPSSEELQANKATLVCLISDFYPGAVTVAWKADSSPVKAGVETTTPSKQSNKKYAASSYLSLTPEQWKSHRSYSCQVTHEGSTVEKTVAPTECS

SEQ ID NO: 526 - protein, 217 aa, Artificial Sequence
  Description of Artificial Sequence: Synthetic polypeptide
  V3-4_IGLJ1*01 S25A/A116T
QTVVTQEPSFSVSPGGTVTLTCGLASGSVSTSYYPSWYQQTPGQAPRTLIYSTNTRSSGVPDRFSGSILGNKAALTITGAQADDESDYYCVLYMGSGISYVFGTGTKVTVLGQPKTAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 527 - protein, 111 aa, Artificial Sequence
  Description of Artificial Sequence: Synthetic polypeptide
  V3-4_IGLJ1*01 V91L/S96P S52F
QTVVTQEPSFSVSPGGTVTLTCGLSSGSVSTSYYPSWYQQTPGQAPRTLIYFTNTRSSGVPDRFSGSILGNKAALTITGAQADDESDYYCLLYMGPGISYVFGTGTKVTVL

SEQ ID NO: 528 - protein, 111 aa, Artificial Sequence
  Description of Artificial Sequence: Synthetic polypeptide
  V3-4_IGLJ1*01 V91L/S96P S52L
QTVVTQEPSFSVSPGGTVTLTCGLSSGSVSTSYYPSWYQQTPGQAPRTLIYLTNTRSSGVPDRFSGSILGNKAALTITGAQADDESDYYCLLYMGPGISYVFGTGTKVTVL

SEQ ID NO: 529 - protein, 111 aa, Artificial Sequence
  Description of Artificial Sequence: Synthetic polypeptide
  V3-4_IGLJ1*01 V91L/S96P S52I
QTVVTQEPSFSVSPGGTVTLTCGLSSGSVSTSYYPSWYQQTPGQAPRTLIYITNTRSSGVPDRFSGSILGNKAALTITGAQADDESDYYCLLYMGPGISYVFGTGTKVTVL

SEQ ID NO: 530 - protein, 111 aa, Artificial Sequence
  Description of Artificial Sequence: Synthetic polypeptide
  V3-4_IGLJ1*01 V91L/S96P S52M
QTVVTQEPSFSVSPGGTVTLTCGLSSGSVSTSYYPSWYQQTPGQAPRTLIYMTNTRSSGVPDRFSGSILGNKAALTITGAQADDESDYYCLLYMGPGISYVFGTGTKVTVL

SEQ ID NO: 531 - protein, 111 aa, Artificial Sequence
  Description of Artificial Sequence: Synthetic polypeptide
  V3-4_IGLJ1*01 V91L/S96P S52V
QTVVTQEPSFSVSPGGTVTLTCGLSSGSVSTSYYPSWYQQTPGQAPRTLIYVTNTRSSGVPDRFSGSILGNKAALTITGAQADDESDYYCLLYMGPGISYVFGTGTKVTVL

SEQ ID NO: 532 - protein, 111 aa, Artificial Sequence
  Description of Artificial Sequence: Synthetic polypeptide
  V3-4_IGLJ1*01 V91L/S96P S52P
QTVVTQEPSFSVSPGGTVTLTCGLSSGSVSTSYYPSWYQQTPGQAPRTLIYPTNTRSSGVPDRFSGSILGNKAALTITGAQADDESDYYCLLYMGPGISYVFGTGTKVTVL

SEQ ID NO: 533 - protein, 111 aa, Artificial Sequence
  Description of Artificial Sequence: Synthetic polypeptide
  V3-4_IGLJ1*01 V91L/S96P S52T
QTVVTQEPSFSVSPGGTVTLTCGLSSGSVSTSYYPSWYQQTPGQAPRTLIYTTNTRSSGVPDRFSGSILGNKAALTITGAQADDESDYYCLLYMGPGISYVFGTGTKVTVL

SEQ ID NO: 534 - protein, 111 aa, Artificial Sequence
  Description of Artificial Sequence: Synthetic polypeptide
  V3-4_IGLJ1*01 V91L/S96P S52Y
QTVVTQEPSFSVSPGGTVTLTCGLSSGSVSTSYYPSWYQQTPGQAPRTLIYYTNTRSSGVPDRFSGSILGNKAALTITGAQADDESDYYCLLYMGPGISYVFGTGTKVTVL

SEQ ID NO: 535 - protein, 111 aa, Artificial Sequence
  Description of Artificial Sequence: Synthetic polypeptide
  V3-4_IGLJ1*01 V91L/S96P S52H
QTVVTQEPSFSVSPGGTVTLTCGLSSGSVSTSYYPSWYQQTPGQAPRTLIYHTNTRSSGVPDRFSGSILGNKAALTITGAQADDESDYYCLLYMGPGISYVFGTGTKVTVL

SEQ ID NO: 536 - protein, 111 aa, Artificial Sequence
  Description of Artificial Sequence: Synthetic polypeptide
  V3-4_IGLJ1*01 V91L/S96P S52Q
QTVVTQEPSFSVSPGGTVTLTCGLSSGSVSTSYYPSWYQQTPGQAPRTLIYQTNTRSSGVPDRFSGSILGNKAALTITGAQADDESDYYCLLYMGPGISYVFGTGTKVTVL

SEQ ID NO: 537 - protein, 111 aa, Artificial Sequence
  Description of Artificial Sequence: Synthetic polypeptide
  V3-4_IGLJ1*01 V91L/S96P S52N
QTVVTQEPSFSVSPGGTVTLTCGLSSGSVSTSYYPSWYQQTPGQAPRTLIYNTNTRSSGVPDRFSGSILGNKAALTITGAQADDESDYYCLLYMGPGISYVFGTGTKVTVL

SEQ ID NO: 538 - protein, 111 aa, Artificial Sequence
  Description of Artificial Sequence: Synthetic polypeptide
  V3-4_IGLJ1*01 V91L/S96P S52K
QTVVTQEPSFSVSPGGTVTLTCGLSSGSVSTSYYPSWYQQTPGQAPRTLIYKTNTRSSGVPDRFSGSILGNKAALTITGAQADDESDYYCLLYMGPGISYVFGTGTKVTVL

SEQ ID NO: 539 - protein, 111 aa, Artificial Sequence
  Description of Artificial Sequence: Synthetic polypeptide
  V3-4_IGLJ1*01 V91L/S96P S52D
QTVVTQEPSFSVSPGGTVTLTCGLSSGSVSTSYYPSWYQQTPGQAPRTLIYDTNTRSSGVPDRFSGSILGNKAALTITGAQADDESDYYCLLYMGPGISYVFGTGTKVTVL

SEQ ID NO: 540 - protein, 111 aa, Artificial Sequence
  Description of Artificial Sequence: Synthetic polypeptide
  V3-4_IGLJ1*01 V91L/S96P S52E
QTVVTQEPSFSVSPGGTVTLTCGLSSGSVSTSYYPSWYQQTPGQAPRTLIYETNTRSSGVPDRFSGSILGNKAALTITGAQADDESDYYCLLYMGPGISYVFGTGTKVTVL

SEQ ID NO: 541 - protein, 111 aa, Artificial Sequence
  Description of Artificial Sequence: Synthetic polypeptide
  V3-4_IGLJ1*01 V91L/S96P S52W
QTVVTQEPSFSVSPGGTVTLTCGLSSGSVSTSYYPSWYQQTPGQAPRTLIYWTNTRSSGVPDRFSGSILGNKAALTITGAQADDESDYYCLLYMGPGISYVFGTGTKVTVL

SEQ ID NO: 542 - protein, 111 aa, Artificial Sequence
  Description of Artificial Sequence: Synthetic polypeptide
  V3-4_IGLJ1*01 V91L/S96P S52R
QTVVTQEPSFSVSPGGTVTLTCGLSSGSVSTSYYPSWYQQTPGQAPRTLIYRTNTRSSGVPDRFSGSILGNKAALTITGAQADDESDYYCLLYMGPGISYVFGTGTKVTVL

SEQ ID NO: 543 - protein, 111 aa, Artificial Sequence
  Description of Artificial Sequence: Synthetic polypeptide
  V3-4_IGLJ1*01 V91L/S96P S52G
QTVVTQEPSFSVSPGGTVTLTCGLSSGSVSTSYYPSWYQQTPGQAPRTLIYGTNTRSSGVPDRFSGSILGNKAALTITGAQADDESDYYCLLYMGPGISYVFGTGTKVTVL

SEQ ID NO: 544 - protein, 111 aa, Artificial Sequence
  Description of Artificial Sequence: Synthetic polypeptide
  V3-4_IGLJ1*01 V91L/S96P
QTVVTQEPSFSVSPGGTVTLTCGLSSGSVSTSYYPSWYQQTPGQAPRTLIYSTNTRSSGVPDRFSGSILGNKAALTITGAQADDESDYYCLLYMGPGISYVFGTGTKVTVL

SEQ ID NO: 545 - protein, 111 aa, Artificial Sequence
  Description of Artificial Sequence: Synthetic polypeptide
  V3-4_IGLJ1*01 V91L/S96P T53F
QTVVTQEPSFSVSPGGTVTLTCGLSSGSVSTSYYPSWYQQTPGQAPRTLIYSFNTRSSGVPDRFSGSILGNKAALTITGAQADDESDYYCLLYMGPGISYVFGTGTKVTVL

SEQ ID NO: 546 - protein, 111 aa, Artificial Sequence
  Description of Artificial Sequence: Synthetic polypeptide
  V3-4_IGLJ1*01 V91L/S96P T53L
QTVVTQEPSFSVSPGGTVTLTCGLSSGSVSTSYYPSWYQQTPGQAPRTLIYSLNTRSSGVPDRFSGSILGNKAALTITGAQADDESDYYCLLYMGPGISYVFGTGTKVTVL

SEQ ID NO: 547 - protein, 111 aa, Artificial Sequence
  Description of Artificial Sequence: Synthetic polypeptide
  V3-4_IGLJ1*01 V91L/S96P T53I
QTVVTQEPSFSVSPGGTVTLTCGLSSGSVSTSYYPSWYQQTPGQAPRTLIYSINTRSSGVPDRFSGSILGNKAALTITGAQADDESDYYCLLYMGPGISYVFGTGTKVTVL

SEQ ID NO: 548 - protein, 111 aa, Artificial Sequence
  Description of Artificial Sequence: Synthetic polypeptide
  V3-4_IGLJ1*01 V91L/S96P T53M
QTVVTQEPSFSVSPGGTVTLTCGLSSGSVSTSYYPSWYQQTPGQAPRTLIYSMNTRSSGVPDRFSGSILGNKAALTITGAQADDESDYYCLLYMGPGISYVFGTGTKVTVL

SEQ ID NO: 549 - protein, 111 aa, Artificial Sequence
  Description of Artificial Sequence: Synthetic polypeptide
  V3-4_IGLJ1*01 V91L/S96P T53V
QTVVTQEPSFSVSPGGTVTLTCGLSSGSVSTSYYPSWYQQTPGQAPRTLIYSVNTRSSGVPDRFSGSILGNKAALTITGAQADDESDYYCLLYMGPGISYVFGTGTKVTVL

SEQ ID NO: 550 - protein, 111 aa, Artificial Sequence
  Description of Artificial Sequence: Synthetic polypeptide
  V3-4_IGLJ1*01 V91L/S96P T53S
QTVVTQEPSFSVSPGGTVTLTCGLSSGSVSTSYYPSWYQQTPGQAPRTLIYSSNTRSSGVPDRFSGSILGNKAALTITGAQADDESDYYCLLYMGPGISYVFGTGTKVTVL

SEQ ID NO: 551 - protein, 111 aa, Artificial Sequence
  Description of Artificial Sequence: Synthetic polypeptide
  V3-4_IGLJ1*01 V91L/S96P T53P
QTVVTQEPSFSVSPGGTVTLTCGLSSGSVSTSYYPSWYQQTPGQAPRTLIYSPNTRSSGVPDRFSGSILGNKAALTITGAQADDESDYYCLLYMGPGISYVFGTGTKVTVL

SEQ ID NO: 552 - protein, 111 aa, Artificial Sequence
  Description of Artificial Sequence: Synthetic polypeptide
  V3-4_IGLJ1*01 V91L/S96P T53Y
QTVVTQEPSFSVSPGGTVTLTCGLSSGSVSTSYYPSWYQQTPGQAPRTLIYSYNTRSSGVPDRFSGSILGNKAALTITGAQADDESDYYCLLYMGPGISYVFGTGTKVTVL

SEQ ID NO: 553 - protein, 111 aa, Artificial Sequence
  Description of Artificial Sequence: Synthetic polypeptide
  V3-4_IGLJ1*01 V91L/S96P T53H
QTVVTQEPSFSVSPGGTVTLTCGLSSGSVSTSYYPSWYQQTPGQAPRTLIYSHNTRSSGVPDRFSGSILGNKAALTITGAQADDESDYYCLLYMGPGISYVFGTGTKVTVL

SEQ ID NO: 554 - protein, 111 aa, Artificial Sequence
  Description of Artificial Sequence: Synthetic polypeptide
  V3-4_IGLJ1*01 V91L/S96P T53Q
QTVVTQEPSFSVSPGGTVTLTCGLSSGSVSTSYYPSWYQQTPGQAPRTLIYSQNTRSSGVPDRFSGSILGNKAALTITGAQADDESDYYCLLYMGPGISYVFGTGTKVTVL

SEQ ID NO: 555 - protein, 111 aa, Artificial Sequence
  Description of Artificial Sequence: Synthetic polypeptide
  V3-4_IGLJ1*01 V91L/S96P T53N
QTVVTQEPSFSVSPGGTVTLTCGLSSGSVSTSYYPSWYQQTPGQAPRTLIYSNNTRSSGVPDRFSGSILGNKAALTITGAQADDESDYYCLLYMGPGISYVFGTGTKVTVL

SEQ ID NO: 556 - protein, 111 aa, Artificial Sequence
  Description of Artificial Sequence: Synthetic polypeptide
  V3-4_IGLJ1*01 V91L/S96P T53K
QTVVTQEPSFSVSPGGTVTLTCGLSSGSVSTSYYPSWYQQTPGQAPRTLIYSKNTRSSGVPDRFSGSILGNKAALTITGAQADDESDYYCLLYMGPGISYVFGTGTKVTVL

SEQ ID NO: 557 - protein, 111 aa, Artificial Sequence
  Description of Artificial Sequence: Synthetic polypeptide
  V3-4_IGLJ1*01 V91L/S96P T53D
QTVVTQEPSFSVSPGGTVTLTCGLSSGSVSTSYYPSWYQQTPGQAPRTLIYSDNTRSSGVPDRFSGSILGNKAALTITGAQADDESDYYCLLYMGPGISYVFGTGTKVTVL

SEQ ID NO: 558 - protein, 111 aa, Artificial Sequence
  Description of Artificial Sequence: Synthetic polypeptide
  V3-4_IGLJ1*01 V91L/S96P T53E
QTVVTQEPSFSVSPGGTVTLTCGLSSGSVSTSYYPSWYQQTPGQAPRTLIYSENTRSSGVPDRFSGSILGNKAALTITGAQADDESDYYCLLYMGPGISYVFGTGTKVTVL

SEQ ID NO: 559 - protein, 111 aa, Artificial Sequence
  Description of Artificial Sequence: Synthetic polypeptide
  V3-4_IGLJ1*01 V91L/S96P T53W
QTVVTQEPSFSVSPGGTVTLTCGLSSGSVSTSYYPSWYQQTPGQAPRTLIYSWNTRSSGVPDRFSGSILGNKAALTITGAQADDESDYYCLLYMGPGISYVFGTGTKVTVL

SEQ ID NO: 560 - protein, 111 aa, Artificial Sequence
  Description of Artificial Sequence: Synthetic polypeptide
  V3-4_IGLJ1*01 V91L/S96P T53R
QTVVTQEPSFSVSPGGTVTLTCGLSSGSVSTSYYPSWYQQTPGQAPRTLIYSRNTRSSGVPDRFSGSILGNKAALTITGAQADDESDYYCLLYMGPGISYVFGTGTKVTVL

SEQ ID NO: 561 - protein, 111 aa, Artificial Sequence
  Description of Artificial Sequence: Synthetic polypeptide
  V3-4_IGLJ1*01 V91L/S96P T53G
QTVVTQEPSFSVSPGGTVTLTCGLSSGSVSTSYYPSWYQQTPGQAPRTLIYSGNTRSSGVPDRFSGSILGNKAALTITGAQADDESDYYCLLYMGPGISYVFGTGTKVTVL

SEQ ID NO: 562 - protein, 111 aa, Artificial Sequence
  Description of Artificial Sequence: Synthetic polypeptide
  V3-4_IGLJ1*01 V91L/S96P S57F
QTVVTQEPSFSVSPGGTVTLTCGLSSGSVSTSYYPSWYQQTPGQAPRTLIYSTNTRFSGVPDRFSGSILGNKAALTITGAQADDESDYYCLLYMGPGISYVFGTGTKVTVL

SEQ ID NO: 563 - protein, 111 aa, Artificial Sequence
  Description of Artificial Sequence: Synthetic polypeptide
  V3-4_IGLJ1*01 V91L/S96P S57L
QTVVTQEPSFSVSPGGTVTLTCGLSSGSVSTSYYPSWYQQTPGQAPRTLIYSTNTRLSGVPDRFSGSILGNKAALTITGAQADDESDYYCLLYMGPGISYVFGTGTKVTVL

SEQ ID NO: 564 - protein, 111 aa, Artificial Sequence
  Description of Artificial Sequence: Synthetic polypeptide
  V3-4_IGLJ1*01 V91L/S96P S57I
QTVVTQEPSFSVSPGGTVTLTCGLSSGSVSTSYYPSWYQQTPGQAPRTLIYSTNTRISGVPDRFSGSILGNKAALTITGAQADDESDYYCLLYMGPGISYVFGTGTKVTVL

SEQ ID NO: 565 - protein, 111 aa, Artificial Sequence
  Description of Artificial Sequence: Synthetic polypeptide
  V3-4_IGLJ1*01 V91L/S96P S57M
QTVVTQEPSFSVSPGGTVTLTCGLSSGSVSTSYYPSWYQQTPGQAPRTLIYSTNTRMSGVPDRFSGSILGNKAALTITGAQADDESDYYCLLYMGPGISYVFGTGTKVTVL

SEQ ID NO: 566 - protein, 111 aa, Artificial Sequence
  Description of Artificial Sequence: Synthetic polypeptide
  V3-4_IGLJ1*01 V91L/S96P S57V
QTVVTQEPSFSVSPGGTVTLTCGLSSGSVSTSYYPSWYQQTPGQAPRTLIYSTNTRVSGVPDRFSGSILGNKAALTITGAQADDESDYYCLLYMGPGISYVFGTGTKVTVL

SEQ ID NO: 567 - protein, 111 aa, Artificial Sequence
  Description of Artificial Sequence: Synthetic polypeptide
  V3-4_IGLJ1*01 V91L/S96P S57P
QTVVTQEPSFSVSPGGTVTLTCGLSSGSVSTSYYPSWYQQTPGQAPRTLIYSTNTRPSGVPDRFSGSILGNKAALTITGAQADDESDYYCLLYMGPGISYVFGTGTKVTVL

SEQ ID NO: 568 - protein, 111 aa, Artificial Sequence
  Description of Artificial Sequence: Synthetic polypeptide
  V3-4_IGLJ1*01 V91L/S96P S57T
QTVVTQEPSFSVSPGGTVTLTCGLSSGSVSTSYYPSWYQQTPGQAPRTLIYSTNTRTSGVPDRFSGSILGNKAALTITGAQADDESDYYCLLYMGPGISYVFGTGTKVTVL

SEQ ID NO: 569 - protein, 111 aa, Artificial Sequence
  Description of Artificial Sequence: Synthetic polypeptide
  V3-4_IGLJ1*01 V91L/S96P S57Y
QTVVTQEPSFSVSPGGTVTLTCGLSSGSVSTSYYPSWYQQTPGQAPRTLIYSTNTRYSGVPDRFSGSILGNKAALTITGAQADDESDYYCLLYMGPGISYVFGTGTKVTVL

SEQ ID NO: 570 - protein, 111 aa, Artificial Sequence
  Description of Artificial Sequence: Synthetic polypeptide
  V3-4_IGLJ1*01 V91L/S96P S57H
QTVVTQEPSFSVSPGGTVTLTCGLSSGSVSTSYYPSWYQQTPGQAPRTLIYSTNTRHSGVPDRFSGSILGNKAALTITGAQADDESDYYCLLYMGPGISYVFGTGTKVTVL

SEQ ID NO: 571 - protein, 111 aa, Artificial Sequence
  Description of Artificial Sequence: Synthetic polypeptide
  V3-4_IGLJ1*01 V91L/S96P S57Q
QTVVTQEPSFSVSPGGTVTLTCGLSSGSVSTSYYPSWYQQTPGQAPRTLIYSTNTRQSGVPDRFSGSILGNKAALTITGAQADDESDYYCLLYMGPGISYVFGTGTKVTVL

SEQ ID NO: 572 - protein, 111 aa, Artificial Sequence
  Description of Artificial Sequence: Synthetic polypeptide
  V3-4_IGLJ1*01 V91L/S96P S57N
QTVVTQEPSFSVSPGGTVTLTCGLSSGSVSTSYYPSWYQQTPGQAPRTLIYSTNTRNSGVPDRFSGSILGNKAALTITGAQADDESDYYCLLYMGPGISYVFGTGTKVTVL

SEQ ID NO: 573 - protein, 111 aa, Artificial Sequence
  Description of Artificial Sequence: Synthetic polypeptide
  V3-4_IGLJ1*01 V91L/S96P S57K
QTVVTQEPSFSVSPGGTVTLTCGLSSGSVSTSYYPSWYQQTPGQAPRTLIYSTNTRKSGVPDRFSGSILGNKAALTITGAQADDESDYYCLLYMGPGISYVFGTGTKVTVL

SEQ ID NO: 574 - protein, 111 aa, Artificial Sequence
  Description of Artificial Sequence: Synthetic polypeptide
  V3-4_IGLJ1*01 V91L/S96P S57D
QTVVTQEPSFSVSPGGTVTLTCGLSSGSVSTSYYPSWYQQTPGQAPRTLIYSTNTRDSGVPDRFSGSILGNKAALTITGAQADDESDYYCLLYMGPGISYVFGTGTKVTVL

SEQ ID NO: 575 - protein, 111 aa, Artificial Sequence
  Description of Artificial Sequence: Synthetic polypeptide
  V3-4_IGLJ1*01 V91L/S96P S57E
QTVVTQEPSFSVSPGGTVTLTCGLSSGSVSTSYYPSWYQQTPGQAPRTLIYSTNTRESGVPDRFSGSILGNKAALTITGAQADDESDYYCLLYMGPGISYVFGTGTKVTVL

SEQ ID NO: 576 - protein, 111 aa, Artificial Sequence
  Description of Artificial Sequence: Synthetic polypeptide
  V3-4_IGLJ1*01 V91L/S96P S57W
QTVVTQEPSFSVSPGGTVTLTCGLSSGSVSTSYYPSWYQQTPGQAPRTLIYSTNTRWSGVPDRFSGSILGNKAALTITGAQADDESDYYCLLYMGPGISYVFGTGTKVTVL

SEQ ID NO: 577 - protein, 111 aa, Artificial Sequence
  Description of Artificial Sequence: Synthetic polypeptide
  V3-4_IGLJ1*01 V91L/S96P S57R
QTVVTQEPSFSVSPGGTVTLTCGLSSGSVSTSYYPSWYQQTPGQAPRTLIYSTNTRRSGVPDRFSGSILGNKAALTITGAQADDESDYYCLLYMGPGISYVFGTGTKVTVL

SEQ ID NO: 578 - protein, 111 aa, Artificial Sequence
  Description of Artificial Sequence: Synthetic polypeptide
  V3-4_IGLJ1*01 V91L/S96P S57G
QTVVTQEPSFSVSPGGTVTLTCGLSSGSVSTSYYPSWYQQTPGQAPRTLIYSTNTRGSGVPDRFSGSILGNKAALTITGAQADDESDYYCLLYMGPGISYVFGTGTKVTVL

SEQ ID NO: 579 - protein, 111 aa, Artificial Sequence
  Description of Artificial Sequence: Synthetic polypeptide
  V3-4_IGLJ1*01 S96A/E
  MOD_RES (96)..(96): Ala or Glu
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGXGISYVFGTGTKVTVL

SEQ ID NO: 580 - protein, 111 aa, Artificial Sequence
  Description of Artificial Sequence: Synthetic polypeptide
  V3-4_IGLJ1*01 G23X
  misc_feature (23)..(23): Xaa is an unknown amino acid residue
QTVVTQEPSFSVSPGGTVTLTCXLSSGSVSTSYYPSWYQQTPGQAPRTLIYSTNTRSSGVPDRFSGSILGNKAALTITGAQADDESDYYCVLYMGSGISYVFGTGTKVTVL

SEQ ID NO: 581 - protein, 111 aa, Artificial Sequence
  Description of Artificial Sequence: Synthetic polypeptide
  V3-4_IGLJ1*01 S52X
  misc_feature (52)..(52): Xaa is an unknown amino acid residue
QTVVTQEPSFSVSPGGTVTLTCGLSSGSVSTSYYPSWYQQTPGQAPRTLIYXTNTRSSGVPDRFSGSILGNKAALTITGAQADDESDYYCVLYMGSGISYVFGTGTKVTVL

SEQ ID NO: 582 - protein, 111 aa, Artificial Sequence
  Description of Artificial Sequence: Synthetic polypeptide
  V3-4_IGLJ1*01 R56X
  misc_feature (56)..(56): Xaa is an unknown amino acid residue
QTVVTQEPSFSVSPGGTVTLTCGLSSGSVSTSYYPSWYQQTPGQAPRTLIYSTNTXSSGVPDRFSGSILGNKAALTITGAQADDESDYYCVLYMGSGISYVFGTGTKVTVL

SEQ ID NO: 583 - protein, 111 aa, Artificial Sequence; identical to SEQ ID NO: 582
  Description of Artificial Sequence: Synthetic polypeptide
  V3-4_IGLJ1*01 R56Y/S
  MOD_RES (56)..(56): Tyr or Ser

SEQ ID NO: 584 - protein, 111 aa, Artificial Sequence
  Description of Artificial Sequence: Synthetic polypeptide
  V3-4_IGLJ1*01 T78Y/M
  MOD_RES (78)..(78): Tyr or Met
QTVVTQEPSFSVSPGGTVTLTCGLSSGSVSTSYYPSWYQQTPGQAPRTLIYSTNTRSSGVPDRFSGSILGNKAALTIXGAQADDESDYYCVLYMGSGISYVFGTGTKVTVL

SEQ ID NO: 585 - protein, 124 aa, Artificial Sequence
  Description of Artificial Sequence: Synthetic polypeptide
  VH1-46_IGHD6-6*01_IGHJ2*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSYWYFDLWGRGTLVTVSSAS

SEQ ID NO: 586 - protein, 123 aa, Artificial Sequence
  Description of Artificial Sequence: Synthetic polypeptide
  VH1-46_IGHD6-6*01_IGHJ4*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSDYFDYWGQGTLVTVSSAS

SEQ ID NO: 587 - protein, 124 aa, Artificial Sequence
  Description of Artificial Sequence: Synthetic polypeptide
  VH1-46_IGHD6-6*01_IGHJ5*01
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAREEYSSSSDNYFDYWGQGTLVTVSSAS

SEQ ID NO: 588 - protein, 124 aa, Artificial Sequence
  Description of Artificial Sequence: Synthetic polypeptide
  VH5-51_IGHD5-18*01>3_IGHJ1*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYAEYFQHWGQGTLVTVSSAS

SEQ ID NO: 589 - protein, 123 aa, Artificial Sequence
  Description of Artificial Sequence: Synthetic polypeptide
  VH5-51_IGHD5-18*01>3_IGHJ3*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYDAFDVWGQGTLVTVSSAS

SEQ ID NO: 590 - protein, 124 aa, Artificial Sequence
  Description of Artificial Sequence: Synthetic polypeptide
  VH5-51_IGHD5-18*01>3_IGHJ5*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSYGYDNWFDSWGQGTLVTVSSAS

SEQ ID NO: 591 - protein, 124 aa, Artificial Sequence
  Description of Artificial Sequence: Synthetic polypeptide
  VH5-51_IGHD5-12*01>3_IGHJ4*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRGYSGYDYDYFDYWGQGTLVTVSSAS

SEQ ID NO: 592 - protein, 123 aa, Artificial Sequence
  Description of Artificial Sequence: Synthetic polypeptide
  VH5-51_IGHD5-24*01>3_IGHJ4*01
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRRDGYNYDYFDYWGQGTLVTVSSAS

SEQ ID NO: 593 - protein, 131 aa, Artificial Sequence
  Description of Artificial Sequence: Synthetic polypeptide
  VH3-23_IGHD2-21*01>3_IGHJ6*01 H100E/S108P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYYYGMDVWGQGTLVTVSSAS

SEQ ID NO: 594 - protein, 109 aa, Artificial Sequence
  Description of Artificial Sequence: Synthetic polypeptide
  V2-13_IGLJ2*01
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVVFGGGTKLTVL

SEQ ID NO: 595 - protein, 131 aa, Artificial Sequence
  Description of Artificial Sequence: Synthetic polypeptide
  VH3-23_IGHD2-21*01>3_IGHJ6*01 E99A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAHIVVVIAISYYYYYYGMDVWGQGTLVTVSSAS

SEQ ID NO: 596 - protein, 131 aa, Artificial Sequence
  Description of Artificial Sequence: Synthetic polypeptide
  VH3-23_IGHD2-21*01>3_IGHJ6*01 H100A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEAIVVVIAISYYYYYYGMDVWGQGTLVTVSSAS

SEQ ID NO: 597 - protein, 131 aa, Artificial Sequence
  Description of Artificial Sequence: Synthetic polypeptide
  VH3-23_IGHD2-21*01>3_IGHJ6*01 I101A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHAVVVIAISYYYYYYGMDVWGQGTLVTVSSAS

SEQ ID NO: 598 - protein, 131 aa, Artificial Sequence
  Description of Artificial Sequence: Synthetic polypeptide
  VH3-23_IGHD2-21*01>3_IGHJ6*01 V102A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIAVVIAISYYYYYYGMDVWGQGTLVTVSSAS

SEQ ID NO: 599 - protein, 131 aa, Artificial Sequence
  Description of Artificial Sequence: Synthetic polypeptide
  VH3-23_IGHD2-21*01>3_IGHJ6*01 V103A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVAVIAISYYYYYYGMDVWGQGTLVTVSSAS

SEQ ID NO: 600 - protein, 131 aa, Artificial Sequence
  Description of Artificial Sequence: Synthetic polypeptide
  VH3-23_IGHD2-21*01>3_IGHJ6*01 V104A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVAIAISYYYYYYGMDVWGQGTLVTVSSAS

SEQ ID NO: 601 - protein, 131 aa, Artificial Sequence
  Description of Artificial Sequence: Synthetic polypeptide
  VH3-23_IGHD2-21*01>3_IGHJ6*01 I105A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVAAISYYYYYYGMDVWGQGTLVTVSSAS

SEQ ID NO: 602 - protein, 131 aa, Artificial Sequence
  Description of Artificial Sequence: Synthetic polypeptide
  VH3-23_IGHD2-21*01>3_IGHJ6*01 A106T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVITISYYYYYYGMDVWGQGTLVTVSSAS

SEQ ID NO: 603 - protein, 131 aa, Artificial Sequence
  Description of Artificial Sequence: Synthetic polypeptide
  VH3-23_IGHD2-21*01>3_IGHJ6*01 I107A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAASYYYYYYGMDVWGQGTLVTVSSAS

SEQ ID NO: 604 - protein, 131 aa, Artificial Sequence
  Description of Artificial Sequence: Synthetic polypeptide
  VH3-23_IGHD2-21*01>3_IGHJ6*01 S108A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAIAYYYYYYGMDVWGQGTLVTVSSAS

SEQ ID NO: 605 - protein, 131 aa, Artificial Sequence
  Description of Artificial Sequence: Synthetic polypeptide
  VH3-23_IGHD2-21*01>3_IGHJ6*01 H100E/S108P Y113G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 606 - protein, 131 aa, Artificial Sequence
  Description of Artificial Sequence: Synthetic polypeptide
  VH3-23_IGHD2-21*01>3_IGHJ6*01 H100E/S108P Y113I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYIYGMDVWGQGTLVTVSSAS

SEQ ID NO: 607 - protein, 131 aa, Artificial Sequence
  Description of Artificial Sequence: Synthetic polypeptide
  VH3-23_IGHD2-21*01>3_IGHJ6*01 H100E/S108P Y113S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYSYGMDVWGQGTLVTVSSAS

SEQ ID NO: 608 - protein, 131 aa, Artificial Sequence
  Description of Artificial Sequence: Synthetic polypeptide
  VH3-23_IGHD2-21*01>3_IGHJ6*01 H100E/S108P Y113P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYPYGMDVWGQGTLVTVSSAS

SEQ ID NO: 609 - protein, 131 aa, Artificial Sequence
  Description of Artificial Sequence: Synthetic polypeptide
  VH3-23_IGHD2-21*01>3_IGHJ6*01 H100E/S108P Y113T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYTYGMDVWGQGTLVTVSSAS

SEQ ID NO: 610 - protein, 131 aa, Artificial Sequence
  Description of Artificial Sequence: Synthetic polypeptide
  VH3-23_IGHD2-21*01>3_IGHJ6*01 H100E/S108P Y113H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYHYGMDVWGQGTLVTVSSAS

SEQ ID NO: 611 - protein, 131 aa, Artificial Sequence
  Description of Artificial Sequence: Synthetic polypeptide
  VH3-23_IGHD2-21*01>3_IGHJ6*01 H100E/S108P Y113N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYNYGMDVWGQGTLVTVSSAS

SEQ ID NO: 612 - protein, 131 aa, Artificial Sequence
  Description of Artificial Sequence: Synthetic polypeptide
  VH3-23_IGHD2-21*01>3_IGHJ6*01 H100E/S108P Y113E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYEYGMDVWGQGTLVTVSSAS

SEQ ID NO: 613 - protein, 131 aa, Artificial Sequence
  Description of Artificial Sequence: Synthetic polypeptide
  VH3-23_IGHD2-21*01>3_IGHJ6*01 H100E/S108P Y113W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYWYGMDVWGQGTLVTVSSAS

SEQ ID NO: 614 - protein, 131 aa, Artificial Sequence
  Description of Artificial Sequence: Synthetic polypeptide
  VH3-23_IGHD2-21*01>3_IGHJ6*01 H100E/S108P Y113R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYRYGMDVWGQGTLVTVSSAS

SEQ ID NO: 615 - protein, 131 aa, Artificial Sequence
  Description of Artificial Sequence: Synthetic polypeptide
  VH3-23_IGHD2-21*01>3_IGHJ6*01 H100E/S108P/Y113G Y109L
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPLYYYGYGMDVWGQGTLVTVSSAS

SEQ ID NO: 616 - protein, 131 aa, Artificial Sequence
  Description of Artificial Sequence: Synthetic polypeptide
  VH3-23_IGHD2-21*01>3_IGHJ6*01 H100E/S108P/Y113G Y109P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPPYYYGYGMDVWGQGTLVTVSSAS

SEQ ID NO: 617 - protein, 131 aa, Artificial Sequence
  Description of Artificial Sequence: Synthetic polypeptide
  VH3-23_IGHD2-21*01>3_IGHJ6*01 H100E/S108P/Y113G Y109T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPTYYYGYGMDVWGQGTLVTVSSAS

SEQ ID NO: 618 - protein, 131 aa, Artificial Sequence
  Description of Artificial Sequence: Synthetic polypeptide
  VH3-23_IGHD2-21*01>3_IGHJ6*01 H100E/S108P/Y113G Y109H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPHYYYGYGMDVWGQGTLVTVSSAS

SEQ ID NO: 619 - protein, 131 aa, Artificial Sequence
  Description of Artificial Sequence: Synthetic polypeptide
  VH3-23_IGHD2-21*01>3_IGHJ6*01 H100E/S108P/Y113G Y109Q
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPQYYYGYGMDVWGQGTLVTVSSAS

SEQ ID NO: 620 - protein, 131 aa, Artificial Sequence
  Description of Artificial Sequence: Synthetic polypeptide
  VH3-23_IGHD2-21*01>3_IGHJ6*01 H100E/S108P/Y113G Y109D
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPDYYYGYGMDVWGQGTLVTVSSAS

SEQ ID NO: 621 - protein, 131 aa, Artificial Sequence
  Description of Artificial Sequence: Synthetic polypeptide
  VH3-23_IGHD2-21*01>3_IGHJ6*01 H100E/S108P/Y113G Y109W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPWYYYGYGMDVWGQGTLVTVSSAS

SEQ ID NO: 622 - protein, 131 aa, Artificial Sequence
  Description of Artificial Sequence: Synthetic polypeptide
  VH3-23_IGHD2-21*01>3_IGHJ6*01 H100E/S108P/Y113G Y109R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPRYYYGYGMDVWGQGTLVTVSSAS

SEQ ID NO: 623 - protein, 131 aa, Artificial Sequence
  Description of Artificial Sequence: Synthetic polypeptide
  VH3-23_IGHD2-21*01>3_IGHJ6*01 H100E/S108P/Y113G Y109G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPGYYYGYGMDVWGQGTLVTVSSAS

SEQ ID NO: 624 - protein, 131 aa, Artificial Sequence
  Description of Artificial Sequence: Synthetic polypeptide
  VH3-23_IGHD2-21*01>3_IGHJ6*01 H100E/S108P/Y113G Y110I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYIYYGYGMDVWGQGTLVTVSSAS

SEQ ID NO: 625 - protein, 131 aa, Artificial Sequence
  Description of Artificial Sequence: Synthetic polypeptide
  VH3-23_IGHD2-21*01>3_IGHJ6*01 H100E/S108P/Y113G Y110S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYSYYGYGMDVWGQGTLVTVSSAS

SEQ ID NO: 626 - protein, 131 aa, Artificial Sequence
  Description of Artificial Sequence: Synthetic polypeptide
  VH3-23_IGHD2-21*01>3_IGHJ6*01 H100E/S108P/Y113G Y110P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYPYYGYGMDVWGQGTLVTVSSAS

SEQ ID NO: 627 - protein, 131 aa, Artificial Sequence
  Description of Artificial Sequence: Synthetic polypeptide
  VH3-23_IGHD2-21*01>3_IGHJ6*01 H100E/S108P/Y113G Y110T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYTYYGYGMDVWGQGTLVTVSSAS

SEQ ID NO: 628 - protein, 131 aa, Artificial Sequence
  Description of Artificial Sequence: Synthetic polypeptide
  VH3-23_IGHD2-21*01>3_IGHJ6*01 H100E/S108P/Y113G Y110H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYHYYGYGMDVWGQGTLVTVSSAS

SEQ ID NO: 629 - protein, 131 aa, Artificial Sequence
  Description of Artificial Sequence: Synthetic polypeptide
  VH3-23_IGHD2-21*01>3_IGHJ6*01 H100E/S108P/Y113G Y110N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYNYYGYGMDVWGQGTLVTVSSAS

SEQ ID NO: 630 - protein, 131 aa, Artificial Sequence
  Description of Artificial Sequence: Synthetic polypeptide
  VH3-23_IGHD2-21*01>3_IGHJ6*01 H100E/S108P/Y113G Y110E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYEYYGYGMDVWGQGTLVTVSSAS

SEQ ID NO: 631 - protein, 131 aa, Artificial Sequence
  Description of Artificial Sequence: Synthetic polypeptide
  VH3-23_IGHD2-21*01>3_IGHJ6*01 H100E/S108P/Y113G Y110W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYWYYGYGMDVWGQGTLVTVSSAS

SEQ ID NO: 632 - protein, 131 aa, Artificial Sequence
  Description of Artificial Sequence: Synthetic polypeptide
  VH3-23_IGHD2-21*01>3_IGHJ6*01 H100E/S108P/Y113G Y110R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYRYYGYGMDVWGQGTLVTVSSAS

SEQ ID NO: 633 - protein, 131 aa, Artificial Sequence
  Description of Artificial Sequence: Synthetic polypeptide
  VH3-23_IGHD2-21*01>3_IGHJ6*01 H100E/S108P/Y113G Y110G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYGYYGYGMDVWGQGTLVTVSSAS

SEQ ID NO: 634 - protein, 131 aa, Artificial Sequence
  Description of Artificial Sequence: Synthetic polypeptide
  VH3-23_IGHD2-21*01>3_IGHJ6*01 H100E/S108P/Y113G Y111I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYIYGYGMDVWGQGTLVTVSSAS

SEQ ID NO: 635 - protein, 131 aa, Artificial Sequence
  Description of Artificial Sequence: Synthetic polypeptide
  VH3-23_IGHD2-21*01>3_IGHJ6*01 H100E/S108P/Y113G Y111S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYSYGYGMDVWGQGTLVTVSSAS

SEQ ID NO: 636 - protein, 131 aa, Artificial Sequence
  Description of Artificial Sequence: Synthetic polypeptide
  VH3-23_IGHD2-21*01>3_IGHJ6*01 H100E/S108P/Y113G Y111P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYPYGYGMDVWGQGTLVTVSSAS

SEQ ID NO: 637 - protein, 131 aa, Artificial Sequence
  Description of Artificial Sequence: Synthetic polypeptide
  VH3-23_IGHD2-21*01>3_IGHJ6*01 H100E/S108P/Y113G Y111T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYTYGYGMDVWGQGTLVTVSSAS

SEQ ID NO: 638 - protein, 131 aa, Artificial Sequence
  Description of Artificial Sequence: Synthetic polypeptide
  VH3-23_IGHD2-21*01>3_IGHJ6*01 H100E/S108P/Y113G Y111H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYHYGYGMDVWGQGTLVTVSSAS

SEQ ID NO: 639 - protein, 131 aa, Artificial Sequence
  Description of Artificial Sequence: Synthetic polypeptide
  VH3-23_IGHD2-21*01>3_IGHJ6*01 H100E/S108P/Y113G Y111N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYNYGYGMDVWGQGTLVTVSSAS

SEQ ID NO: 640 - protein, 131 aa, Artificial Sequence
  Description of Artificial Sequence: Synthetic polypeptide
  VH3-23_IGHD2-21*01>3_IGHJ6*01 H100E/S108P/Y113G Y111E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYEYGYGMDVWGQGTLVTVSSAS

SEQ ID NO: 641 - protein, 131 aa, Artificial Sequence
  Description of Artificial Sequence: Synthetic polypeptide
  VH3-23_IGHD2-21*01>3_IGHJ6*01 H100E/S108P/Y113G Y111W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYWYGYGMDVWGQGTLVTVSSAS

SEQ ID NO: 642 - protein, 131 aa, Artificial Sequence
  Description of Artificial Sequence: Synthetic polypeptide
  VH3-23_IGHD2-21*01>3_IGHJ6*01 H100E/S108P/Y113G Y111R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYRYGYGMDVWGQGTLVTVSSAS

SEQ ID NO: 643 - protein, 131 aa, Artificial Sequence
  Description of Artificial Sequence: Synthetic polypeptide
  VH3-23_IGHD2-21*01>3_IGHJ6*01 H100E/S108P/Y113G Y111G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYGYGYGMDVWGQGTLVTVSSAS

SEQ ID NO: 644 - protein, 131 aa, Artificial Sequence
  Description of Artificial Sequence: Synthetic polypeptide
  VH3-23_IGHD2-21*01>3_IGHJ6*01 H100E/S108P/Y113G Y112I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYIGYGMDVWGQGTLVTVSSAS

SEQ ID NO: 645 - protein, 131 aa, Artificial Sequence
  Description of Artificial Sequence: Synthetic polypeptide
  VH3-23_IGHD2-21*01>3_IGHJ6*01 H100E/S108P/Y113G Y112S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYSGYGMDVWGQGTLVTVSSAS

SEQ ID NO: 646 - protein, 131 aa, Artificial Sequence
  Description of Artificial Sequence: Synthetic polypeptide
  VH3-23_IGHD2-21*01>3_IGHJ6*01 H100E/S108P/Y113G Y112P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYPGYGMDVWGQGTLVTVSSAS

SEQ ID NO: 647 - protein, 131 aa, Artificial Sequence
  Description of Artificial Sequence: Synthetic polypeptide
  VH3-23_IGHD2-21*01>3_IGHJ6*01 H100E/S108P/Y113G Y112T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYTGYGMDVWGQGTLVTVSSAS

SEQ ID NO: 648 - protein, 131 aa, Artificial Sequence
  Description of Artificial Sequence: Synthetic polypeptide
  VH3-23_IGHD2-21*01>3_IGHJ6*01 H100E/S108P/Y113G Y112H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYHGYGMDVWGQGTLVTVSSAS

SEQ ID NO: 649 - protein, 131 aa, Artificial Sequence
  Description of Artificial Sequence: Synthetic polypeptide
  VH3-23_IGHD2-21*01>3_IGHJ6*01 H100E/S108P/Y113G Y112N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYNGYGMDVWGQGTLVTVSSAS

SEQ ID NO: 650 - protein, 131 aa, Artificial Sequence
  Description of Artificial Sequence: Synthetic polypeptide
  VH3-23_IGHD2-21*01>3_IGHJ6*01 H100E/S108P/Y113G Y112E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYEGYGMDVWGQGTLVTVSSAS

SEQ ID NO: 651 - protein, 131 aa, Artificial Sequence
  Description of Artificial Sequence: Synthetic polypeptide
  VH3-23_IGHD2-21*01>3_IGHJ6*01 H100E/S108P/Y113G Y112W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYWGYGMDVWGQGTLVTVSSAS

SEQ ID NO: 652 - protein, 131 aa, Artificial Sequence
  Description of Artificial Sequence: Synthetic polypeptide
  VH3-23_IGHD2-21*01>3_IGHJ6*01 H100E/S108P/Y113G Y112R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYRGYGMDVWGQGTLVTVSSAS

SEQ ID NO: 653 - protein, 131 aa, Artificial Sequence
  Description of Artificial Sequence: Synthetic polypeptide
  VH3-23_IGHD2-21*01>3_IGHJ6*01 H100E/S108P/Y113G Y112G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYGGYGMDVWGQGTLVTVSSAS

SEQ ID NO: 654 - protein, 131 aa, Artificial Sequence
  Description of Artificial Sequence: Synthetic polypeptide
  VH3-23_IGHD2-21*01>3_IGHJ6*01 H100E/S108P/Y113G Y114I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGIGMDVWGQGTLVTVSSAS

SEQ ID NO: 655 - protein, 131 aa, Artificial Sequence
  Description of Artificial Sequence: Synthetic polypeptide
  VH3-23_IGHD2-21*01>3_IGHJ6*01 H100E/S108P/Y113G Y114S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGSGMDVWGQGTLVTVSSAS

SEQ ID NO: 656 - protein, 131 aa, Artificial Sequence
  Description of Artificial Sequence: Synthetic polypeptide
  VH3-23_IGHD2-21*01>3_IGHJ6*01 H100E/S108P/Y113G Y114P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGPGMDVWGQGTLVTVSSAS

SEQ ID NO: 657 - protein, 131 aa, Artificial Sequence
  Description of Artificial Sequence: Synthetic polypeptide
  VH3-23_IGHD2-21*01>3_IGHJ6*01 H100E/S108P/Y113G Y114T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGTGMDVWGQGTLVTVSSAS

SEQ ID NO: 658 - protein, 131 aa, Artificial Sequence
  Description of Artificial Sequence: Synthetic polypeptide
  VH3-23_IGHD2-21*01>3_IGHJ6*01 H100E/S108P/Y113G Y114H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGHGMDVWGQGTLVTVSSAS

SEQ ID NO: 659 - protein, 131 aa, Artificial Sequence
  Description of Artificial Sequence: Synthetic polypeptide
  VH3-23_IGHD2-21*01>3_IGHJ6*01 H100E/S108P/Y113G Y114N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGNGMDVWGQGTLVTVSSAS

SEQ ID NO: 660 - protein, 131 aa, Artificial Sequence
  Description of Artificial Sequence: Synthetic polypeptide
  VH3-23_IGHD2-21*01>3_IGHJ6*01 H100E/S108P/Y113G Y114E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGEGMDVWGQGTLVTVSSAS

SEQ ID NO: 661 - protein, 131 aa, Artificial Sequence
  Description of Artificial Sequence: Synthetic polypeptide
  VH3-23_IGHD2-21*01>3_IGHJ6*01 H100E/S108P/Y113G Y114W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGWGMDVWGQGTLVTVSSAS

SEQ ID NO: 662 - protein, 131 aa, Artificial Sequence
  Description of Artificial Sequence: Synthetic polypeptide
  VH3-23_IGHD2-21*01>3_IGHJ6*01 H100E/S108P/Y113G Y114R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGRGMDVWGQGTLVTVSSAS

SEQ ID NO: 663 - protein, 131 aa, Artificial Sequence
  Description of Artificial Sequence: Synthetic polypeptide
  VH3-23_IGHD2-21*01>3_IGHJ6*01 H100E/S108P/Y113G Y114G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEEIVVVIAIPYYYYGGGMDVWGQGTLVTVSSAS

SEQ ID NO: 664 - protein, 131 aa, Artificial Sequence
  Description of Artificial Sequence: Synthetic polypeptide
  VH3-23_IGHD2-21*01>3_IGHJ6*01 H100E/S108P/Y113G G26A
EVQLLESGGGLVQPGGSLRLSCAASAFTFSSYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 665 - protein, 131 aa, Artificial Sequence
  Description of Artificial Sequence: Synthetic polypeptide
  VH3-23_IGHD2-21*01>3_IGHJ6*01 H100E/S108P/Y113G F27A
EVQLLESGGGLVQPGGSLRLSCAASGATFSSYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 666 - protein, 131 aa, Artificial Sequence
  Description of Artificial Sequence: Synthetic polypeptide
  VH3-23_IGHD2-21*01>3_IGHJ6*01 H100E/S108P/Y113G T28A
EVQLLESGGGLVQPGGSLRLSCAASGFAFSSYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 667 - protein, 131 aa, Artificial Sequence
  Description of Artificial Sequence: Synthetic polypeptide
  VH3-23_IGHD2-21*01>3_IGHJ6*01 H100E/S108P/Y113G F29A
EVQLLESGGGLVQPGGSLRLSCAASGFTASSYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 668 - protein, 131 aa, Artificial Sequence
  Description of Artificial Sequence: Synthetic polypeptide
  VH3-23_IGHD2-21*01>3_IGHJ6*01 H100E/S108P/Y113G S30A
EVQLLESGGGLVQPGGSLRLSCAASGFTFASYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 669 - protein, 131 aa, Artificial Sequence
  Description of Artificial Sequence: Synthetic polypeptide
  VH3-23_IGHD2-21*01>3_IGHJ6*01 H100E/S108P/Y113G S31A
EVQLLESGGGLVQPGGSLRLSCAASGFTFSAYAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 670 - protein, 131 aa, Artificial Sequence
  Description of Artificial Sequence: Synthetic polypeptide
  VH3-23_IGHD2-21*01>3_IGHJ6*01 H100E/S108P/Y113G Y32A
EVQLLESGGGLVQPGGSLRLSCAASGFTFSSAAMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 671 - protein, 131 aa, Artificial Sequence
  Description of Artificial Sequence: Synthetic polypeptide
  VH3-23_IGHD2-21*01>3_IGHJ6*01 H100E/S108P/Y113G A33T
EVQLLESGGGLVQPGGSLRLSCAASGFTFSSYTMSWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 672 - protein, 131 aa, Artificial Sequence
  Description of Artificial Sequence: Synthetic polypeptide
  VH3-23_IGHD2-21*01>3_IGHJ6*01 H100E/S108P/Y113G M34A
EVQLLESGGGLVQPGGSLRLSCAASGFTFSSYAASWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 673 - protein, 131 aa, Artificial Sequence
  Description of Artificial Sequence: Synthetic polypeptide
  VH3-23_IGHD2-21*01>3_IGHJ6*01 H100E/S108P/Y113G S35A
EVQLLESGGGLVQPGGSLRLSCAASGFTFSSYAMAWVRQAPGKGLEWVSSISGSGGSTYYADSVKGRFTISRDNSKNTLYLQMNSLRAEDTAVYYCAKEEIVVVIAIPYYYYGYGMDVWGQGTLVTVSSAS

SEQ ID NO: 674 - protein, 131 aa, Artificial Sequence
  Description of Artificial Sequence: Synthetic polypeptide
  VH3-23_IGHD2-21*01>3_IGHJ6*01 H100E/S108P/Y113G I51A
EVQLLESGGGLVQPGGSLRLSCAASGFTFSSYAMSWVRQAPGKGLEWVSSASGSGGSTYYADSVKGRFTISRDNSKNTLYLQMNSLRAEDTAVYYCAKEEIVVVIAIPYYYYGYGMDVWGQGTLVTVSSAS

SEQ ID NO: 675 - protein, 131 aa, Artificial Sequence
  Description of Artificial Sequence: Synthetic polypeptide
  VH3-23_IGHD2-21*01>3_IGHJ6*01 H100E/S108P/Y113G S52A/G53A
EVQLLESGGGLVQPGGSLRLSCAASGFTFSSYAMSWVRQAPGKGLEWVSSIAASGGSTYYADSVKGRFTISRDNSKNTLYLQMNSLRAEDTAVYYCAKEEIVVVIAIPYYYYGYGMDVWGQGTLVTVSSAS

SEQ ID NO: 676 - protein, 131 aa, Artificial Sequence
  Description of Artificial Sequence: Synthetic polypeptide
  VH3-23_IGHD2-21*01>3_IGHJ6*01 H100E/S108P/Y113G G53A
EVQLLESGGGLVQPGGSLRLSCAASGFTFSSYAMSWVRQAPGKGLEWVSSISASGGSTYYADSVKGRFTISRDNSKNTLYLQMNSLRAEDTAVYYCAKEEIVVVIAIPYYYYGYGMDVWGQGTLVTVSSAS

SEQ ID NO: 677 - protein, 131 aa, Artificial Sequence
  Description of Artificial Sequence: Synthetic polypeptide
  VH3-23_IGHD2-21*01>3_IGHJ6*01 H100E/S108P/Y113G S54A
EVQLLESGGGLVQPGGSLRLSCAASGFTFSSYAMSWVRQAPGKGLEWVSSISGAGGSTYYADSVKGRFTISRDNSKNTLYLQMNSLRAEDTAVYYCAKEEIVVVIAIPYYYYGYGMDVWGQGTLVTVSSAS

SEQ ID NO: 678 - protein, 131 aa, Artificial Sequence
  Description of Artificial Sequence: Synthetic polypeptide
  VH3-23_IGHD2-21*01>3_IGHJ6*01 H100E/S108P/Y113G G55A
EVQLLESGGGLVQPGGSLRLSCAASGFTFSSYAMSWVRQAPGKGLEWVSSISGSAGSTYYADSVKGRFTISRDNSKNTLYLQMNSLRAEDTAVYYCAKEEIVVVIAIPYYYYGYGMDVWGQGTLVTVSSAS

SEQ ID NO: 679 - protein, 131 aa, Artificial Sequence
  Description of Artificial Sequence: Synthetic polypeptide
  VH3-23_IGHD2-21*01>3_IGHJ6*01 H100E/S108P/Y113G G56A
EVQLLESGGGLVQPGGSLRLSCAASGFTFSSYAMSWVRQAPGKGLEWVSSISGSGASTYYADSVKGRFTISRDNSKNTLYLQMNSLRAEDTAVYYCAKEEIVVVIAIPYYYYGYGMDVWGQGTLVTVSSAS

SEQ ID NO: 680 - protein, 131 aa, Artificial Sequence
  Description of Artificial Sequence: Synthetic polypeptide
  VH3-23_IGHD2-21*01>3_IGHJ6*01 H100E/S108P/Y113G S57A
EVQLLESGGGLVQPGGSLRLSCAASGFTFSSYAMSWVRQAPGKGLEWVSSISGSGGATYYADSVKGRFTISRDNSKNTLYLQMNSLRAEDTAVYYCAKEEIVVVIAIPYYYYGYGMDVWGQGTLVTVSSAS

SEQ ID NO: 681 - protein, 131 aa, Artificial Sequence
  Description of Artificial Sequence: Synthetic polypeptide
  VH3-23_IGHD2-21*01>3_IGHJ6*01 H100E/S108P/Y113G T58A
EVQLLESGGGLVQPGGSLRLSCAASGFTFSSYAMSWVRQAPGKGLEWVSSISGSGGSAYYADSVKGRFTISRDNSKNTLYLQMNSLRAEDTAVYYCAKEEIVVVIAIPYYYYGYGMDVWGQGTLVTVSSAS

SEQ ID NO: 682 - protein, 131 aa, Artificial Sequence
  Description of Artificial Sequence: Synthetic polypeptide
  VH3-23_IGHD2-21*01>3_IGHJ6*01 H100E/S108P/Y113G Y59A
EVQLLESGGGLVQPGGSLRLSCAASGFTFSSYAMSWVRQAPGKGLEWVSSISGSGGSTAYADSVKGRFTISRDNSKNTLYLQMNSLRAEDTAVYYCAKEEIVVVIAIPYYYYGYGMDVWGQGTLVTVSSAS

SEQ ID NO: 683 - protein, 131 aa, Artificial Sequence
  Description of Artificial Sequence: Synthetic polypeptide
  VH3-23_IGHD2-21*01>3_IGHJ6*01 H100E/S108P/Y113G Y60A
EVQLLESGGGLVQPGGSLRLSCAASGFTFSSYAMSWVRQAPGKGLEWVSSISGSGGSTYAADSVKGRFTISRDNSKNTLYLQMNSLRAEDTAVYYCAKEEIVVVIAIPYYYYGYGMDVWGQGTLVTVSSAS

SEQ ID NO: 684 - protein, 131 aa, Artificial Sequence
  Description of Artificial Sequence: Synthetic polypeptide
  VH3-23_IGHD2-21*01>3_IGHJ6*01 H100E/S108P/Y113G A61T
EVQLLESGGGLVQPGGSLRLSCAASGFTFSSYAMSWVRQAPGKGLEWVSSISGSGGSTYYTDSVKGRFTISRDNSKNTLYLQMNSLRAEDTAVYYCAKEEIVVVIAIPYYYYGYGMDVWGQGTLVTVSSAS

SEQ ID NO: 685 - protein, 131 aa, Artificial Sequence
  Description of Artificial Sequence: Synthetic polypeptide
  VH3-23_IGHD2-21*01>3_IGHJ6*01 H100E/S108P/Y113G D62A
EVQLLESGGGLVQPGGSLRLSCAASGFTFSSYAMSWVRQAPGKGLEWVSSISGSGGSTYYAASVKGRFTISRDNSKNTLYLQMNSLRAEDTAVYYCAKEEIVVVIAIPYYYYGYGMDVWGQGTLVTVSSAS

SEQ ID NO: 686 - protein, 131 aa, Artificial Sequence
  Description of Artificial Sequence: Synthetic polypeptide
  VH3-23_IGHD2-21*01>3_IGHJ6*01 H100E/S108P/Y113G V64A
EVQLLESGGGLVQPGGSLRLSCAASGFTFSSYAMSWVRQAPGKGLEWVSSISGSGGSTYYADSAKGRFTISRDNSKNTLYLQMNSLRAEDTAVYYCAKEEIVVVIAIPYYYYGYGMDVWGQGTLVTVSSAS

SEQ ID NO: 687 - protein, 131 aa, Artificial Sequence
  Description of Artificial Sequence: Synthetic polypeptide
  VH3-23_IGHD2-21*01>3_IGHJ6*01 H100E/S108P/Y113G K65A
EVQLLESGGGLVQPGGSLRLSCAASGFTFSSYAMSWVRQAPGKGLEWVSSISGSGGSTYYADSVAGRFTISRDNSKNTLYLQMNSLRAEDTAVYYCAKEEIVVVIAIPYYYYYYGMDVWGQGTLVTVSSAS

SEQ ID NO: 688 - protein, 132 aa, Artificial Sequence; identical to SEQ ID NO: 104
  Description of Artificial Sequence: Synthetic polypeptide
  VH3-23_IGHD3-10*01>3_IGHJ6*01

SEQ ID NO: 689 - protein, 132 aa, Artificial Sequence
  Description of Artificial Sequence: Synthetic polypeptide
  VH3-23_IGHD3-10*01>3_IGHJ6*01 Y114N
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYNYGMDVWGQGTLVTVSSAS

SEQ ID NO: 690 - protein, 132 aa, Artificial Sequence
  Description of Artificial Sequence: Synthetic polypeptide
  VH3-23_IGHD3-10*01>3_IGHJ6*01 Y114T
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYTYGMDVWGQGTLVTVSSAS

SEQ ID NO: 691 - protein, 132 aa, Artificial Sequence
  Description of Artificial Sequence: Synthetic polypeptide
  VH3-23_IGHD3-10*01>3_IGHJ6*01 Y114I
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYIYGMDVWGQGTLVTVSSAS

SEQ ID NO: 692 - protein, 132 aa, Artificial Sequence
  Description of Artificial Sequence: Synthetic polypeptide
  VH3-23_IGHD3-10*01>3_IGHJ6*01 Y115P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYPGMDVWGQGTLVTVSSAS

SEQ ID NO: 693 - protein, 132 aa, Artificial Sequence
  Description of Artificial Sequence: Synthetic polypeptide
  VH3-23_IGHD3-10*01>3_IGHJ6*01 Y115R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYRGMDVWGQGTLVTVSSAS

SEQ ID NO: 694 - protein, 132 aa, Artificial Sequence
  Description of Artificial Sequence: Synthetic polypeptide
  VH3-23_IGHD3-10*01>3_IGHJ6*01 Y115G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYGGMDVWGQGTLVTVSSAS

SEQ ID NO: 695 - protein, 132 aa, Artificial Sequence
  Description of Artificial Sequence: Synthetic polypeptide
  VH3-23_IGHD3-10*01>3_IGHJ6*01 Y115E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYYEGMDVWGQGTLVTVSSAS

SEQ ID NO: 696 - protein, 132 aa, Artificial Sequence
  Description of Artificial Sequence: Synthetic polypeptide
  VH3-23_IGHD3-10*01>3_IGHJ6*01 R104A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVAGVIISYYYYYYGMDVWGQGTLVTVSSAS

SEQ ID NO: 697 - protein, 129 aa, Artificial Sequence
  Description of Artificial Sequence: Synthetic polypeptide
  VH3-23_IGHD3-10*01>3_IGHJ6*01 3Y DELETION
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYGMDVWGQGTLVTVSSAS

SEQ ID NO: 698 - protein, 132 aa, Artificial Sequence
  Description of Artificial Sequence: Synthetic polypeptide
  VH3-23_IGHD3-10*01>3_IGHJ6*01 Y110V
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISVYYYYYGMDVWGQGTLVTVSSAS

SEQ ID NO: 699 - protein, 132 aa, Artificial Sequence
  Description of Artificial Sequence: Synthetic polypeptide
  VH3-23_IGHD3-10*01>3_IGHJ6*01 Y110S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISSYYYYYGMDVWGQGTLVTVSSAS

SEQ ID NO: 700 - protein, 132 aa, Artificial Sequence
  Description of Artificial Sequence: Synthetic polypeptide
  VH3-23_IGHD3-10*01>3_IGHJ6*01 Y110P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISPYYYYYGMDVWGQGTLVTVSSAS

SEQ ID NO: 701 - protein, 132 aa, Artificial Sequence
  Description of Artificial Sequence: Synthetic polypeptide
  VH3-23_IGHD3-10*01>3_IGHJ6*01 Y110G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISGYYYYYGMDVWGQGTLVTVSSAS

SEQ ID NO: 702 - protein, 132 aa, Artificial Sequence
  Description of Artificial Sequence: Synthetic polypeptide
  VH3-23_IGHD3-10*01>3_IGHJ6*01 Y110R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISRYYYYYGMDVWGQGTLVTVSSAS

SEQ ID NO: 703 - protein, 132 aa, Artificial Sequence
  Description of Artificial Sequence: Synthetic polypeptide
  VH3-23_IGHD3-10*01>3_IGHJ6*01 Y111S
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYSYYYYGMDVWGQGTLVTVSSAS

SEQ ID NO: 704 - protein, 132 aa, Artificial Sequence
  Description of Artificial Sequence: Synthetic polypeptide
  VH3-23_IGHD3-10*01>3_IGHJ6*01 Y111D
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYDYYYYGMDVWGQGTLVTVSSAS

SEQ ID NO: 705 - protein, 132 aa, Artificial Sequence
  Description of Artificial Sequence: Synthetic polypeptide
  VH3-23_IGHD3-10*01>3_IGHJ6*01 Y111R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYRYYYYGMDVWGQGTLVTVSSAS

SEQ ID NO: 706 - protein, 132 aa, Artificial Sequence
  Description of Artificial Sequence: Synthetic polypeptide
  VH3-23_IGHD3-10*01>3_IGHJ6*01 Y111A
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYAYYYYGMDVWGQGTLVTVSSAS

SEQ ID NO: 707 - protein, 132 aa, Artificial Sequence
  Description of Artificial Sequence: Synthetic polypeptide
  VH3-23_IGHD3-10*01>3_IGHJ6*01 Y111G
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYGYYYYGMDVWGQGTLVTVSSAS

SEQ ID NO: 708 - protein, 132 aa, Artificial Sequence
  Description of Artificial Sequence: Synthetic polypeptide
  VH3-23_IGHD3-10*01>3_IGHJ6*01 Y111Q
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYQYYYYGMDVWGQGTLVTVSSAS

SEQ ID NO: 709 - protein, 132 aa, Artificial Sequence
  Description of Artificial Sequence: Synthetic polypeptide
  VH3-23_IGHD3-10*01>3_IGHJ6*01 Y111P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYPYYYYGMDVWGQGTLVTVSSAS

SEQ ID NO: 710 - protein, 132 aa, Artificial Sequence
  Description of Artificial Sequence: Synthetic polypeptide
  VH3-23_IGHD3-10*01>3_IGHJ6*01 Y111V
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYVYYYYGMDVWGQGTLVTVSSAS

SEQ ID NO: 711 - protein, 132 aa, Artificial Sequence
  Description of Artificial Sequence: Synthetic polypeptide
  VH3-23_IGHD3-10*01>3_IGHJ6*01 Y113H
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYHYYGMDVWGQGTLVTVSSAS

SEQ ID NO: 712 - protein, 132 aa, Artificial Sequence
  Description of Artificial Sequence: Synthetic polypeptide
  VH3-23_IGHD3-10*01>3_IGHJ6*01 Y113L
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYLYYGMDVWGQGTLVTVSSAS

SEQ ID NO: 713 - protein, 132 aa, Artificial Sequence
  Description of Artificial Sequence: Synthetic polypeptide
  VH3-23_IGHD3-10*01>3_IGHJ6*01 Y113W
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYWYYGMDVWGQGTLVTVSSAS

SEQ ID NO: 714 - protein, 132 aa, Artificial Sequence
  Description of Artificial Sequence: Synthetic polypeptide
  VH3-23_IGHD3-10*01>3_IGHJ6*01 Y113E
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYEYYGMDVWGQGTLVTVSSAS

SEQ ID NO: 715 - protein, 132 aa, Artificial Sequence
  Description of Artificial Sequence: Synthetic polypeptide
  VH3-23_IGHD3-10*01>3_IGHJ6*01 Y113P
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYPYYGMDVWGQGTLVTVSSAS

SEQ ID NO: 716 - protein, 132 aa, Artificial Sequence
  Description of Artificial Sequence: Synthetic polypeptide
  VH3-23_IGHD3-10*01>3_IGHJ6*01 Y113K
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYKYYGMDVWGQGTLVTVSSAS

SEQ ID NO: 717 - protein, 132 aa, Artificial Sequence
  Description of Artificial Sequence: Synthetic polypeptide
  VH3-23_IGHD3-10*01>3_IGHJ6*01 Y114K
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYKYGMDVWGQGTLVTVSSAS

SEQ ID NO: 718 - protein, 132 aa, Artificial Sequence
  Description of Artificial Sequence: Synthetic polypeptide
  VH3-23_IGHD3-10*01>3_IGHJ6*01 Y114F
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYFYGMDVWGQGTLVTVSSAS

SEQ ID NO: 719 - protein, 132 aa, Artificial Sequence
  Description of Artificial Sequence: Synthetic polypeptide
  VH3-23_IGHD3-10*01>3_IGHJ6*01 Y114R
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYYYRYGMDVWGQGTLVTVSSAS

SEQ ID NO: 720 - DNA, 374 bp, Artificial Sequence
  Description of Artificial Sequence: Synthetic polynucleotide
  gnl|Fabrus|HerceptinHC
ccatggcaaaggtgcagctggttgaaagcggcggcggtctggtgcagccgggcggtagcctgcgcctgagctgcgcggcgagcggctttaacattaaagatacctatattcattgggtgcgccaggcgccgggtaaaggcctggaatgggtggcgcgcatttatccgaccaatggttatacccgttatgcggatagcgtgaaaggtcgttttaccatcagcgcggataccagcaaaaacaccgcctatctgcagatgaatagcctgcgcgcggaagataccgcggtgtattattgtagccgttggggcggcgatggcttttatgcgatggattattggggccagggcaccctggtgaccgtgagcagcgctagc

SEQ ID NO: 721 - DNA, 377 bp, Artificial Sequence
  Description of Artificial Sequence: Synthetic polynucleotide
  gnl|Fabrus|Anti-CD20 HC
ccatggcacaggcctacctgcagcagagcggcgccgagctggtgaggcccggcgccagcgtgaagatgagctgcaaggccagcggctacaccttcaccagctacaacatgcactgggtgaagcagacccccaggcagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagggtggtgtactacagcaacagctactggtacttcgacgtgtggggcaccggcaccaccgtgaccgtgagcgctagc

SEQ ID NO: 722 - DNA, 380 bp, Artificial Sequence
  Description of Artificial Sequence: Synthetic polynucleotide
  gnl|Fabrus|VH1-18_IGHD1-26*01_IGHJ2*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagggtatagtgggagctactactactggtacttcgatctctggggccgtggcaccctggtcactgtctcctcagctagc

SEQ ID NO: 723 - DNA, 389 bp, Artificial Sequence
  Description of Artificial Sequence: Synthetic polynucleotide
  gnl|Fabrus|VH1-18_IGHD2-21*01_IGHJ2*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaagcatattgtggtggtgattgctattcctactggtacttcgatctctggggccgtggcaccctggtcactgtctcctcagctagc

SEQ ID NO: 724 - DNA, 410 bp, Artificial Sequence
  Description of Artificial Sequence: Synthetic polynucleotide
  gnl|Fabrus|VH1-18_IGHD3-16*01_IGHJ6*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattatgattacgtttgggggagttatgcttataccgattactactactactacggtatggacgtctgggggcaagggaccacggtcaccgtctcctcagctagc

SEQ ID NO: 725 - DNA, 389 bp, Artificial Sequence
  Description of Artificial Sequence: Synthetic polynucleotide
  gnl|Fabrus|VH1-18_IGHD3-22*01_IGHJ4*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagagtattactatgatagtagtggttattactacgactactttgactactggggccaaggaaccctggtcaccgtctcctcagctagc

SEQ ID NO: 726 - DNA, 380 bp, Artificial Sequence
  Description of Artificial Sequence: Synthetic polynucleotide
  gnl|Fabrus|VH1-18_IGHD4-23*01_IGHJ1*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatgactacggtggtaactccgctgaatacttccagcactggggccagggcaccctggtcaccgtctcctcagctagc

SEQ ID NO: 727 - DNA, 380 bp, Artificial Sequence
  Description of Artificial Sequence: Synthetic polynucleotide
  gnl|Fabrus|VH1-18_IGHD5-12*01_IGHJ4*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggtggatatagtggctacgattacgactactttgactactggggccaaggaaccctggtcaccgtctcctcagctagc

SEQ ID NO: 728 - DNA, 380 bp, Artificial Sequence
  Description of Artificial Sequence: Synthetic polynucleotide
  gnl|Fabrus|VH1-18_IGHD6-6*01_IGHJ1*01
ccatggcacaggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagaggagtatagcagctcgtccgctgaatacttccagcactggggccagggcaccctggtcaccgtctcctcagctagc

SEQ ID NO: 729 - DNA, 374 bp, Artificial Sequence
  Description of Artificial Sequence: Synthetic polynucleotide
  gnl|Fabrus|VH1-2_IGHD1-1*01_IGHJ3*01
ccatggcacaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagggtacaactggaacgacgatgcttttgatgtctggggccaagggacaatggtcaccgtctcttcagctagc

SEQ ID NO: 730 - DNA, 374 bp, Artificial Sequence
  Description of Artificial Sequence: Synthetic polynucleotide
  gnl|Fabrus|VH1-24_IGHD1-7*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagggtataactggaactacgactactttgactactggggccaaggaaccctggtcaccgtctcctcagctagc

SEQ ID NO: 731 - DNA, 392 bp, Artificial Sequence
  Description of Artificial Sequence: Synthetic polynucleotide
  gnl|Fabrus|VH1-24_IGHD2-15*01_IGHJ2*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaaggatattgtagtggtggtagctgctactcctactggtacttcgatctctggggccgtggcaccctggtcactgtctcctcagctagc

SEQ ID NO: 732 - DNA, 389 bp, Artificial Sequence
  Description of Artificial Sequence: Synthetic polynucleotide
  gnl|Fabrus|VH1-24_IGHD3-10*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattactatggttcggggagttattataacgactactttgactactggggccaaggaaccctggtcaccgtctcctcagctagc

SEQ ID NO: 733 - DNA, 395 bp, Artificial Sequence
  Description of Artificial Sequence: Synthetic polynucleotide
  gnl|Fabrus|VH1-24_IGHD3-16*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtattatgattacgtttgggggagttatgcttataccgactactttgactactggggccaaggaaccctggtcaccgtctcctcagctagc

SEQ ID NO: 734 - DNA, 380 bp, Artificial Sequence
  Description of Artificial Sequence: Synthetic polynucleotide
  gnl|Fabrus|VH1-24_IGHD4-23*01_IGHJ2*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagatgactacggtggtaactcctactggtacttcgatctctggggccgtggcaccctggtcactgtctcctcagctagc

SEQ ID NO: 735 - DNA, 380 bp, Artificial Sequence
  Description of Artificial Sequence: Synthetic polynucleotide
  gnl|Fabrus|VH1-24_IGHD5-12*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatatagtggctacgattacgactactttgactactggggccaaggaaccctggtcaccgtctcctcagctagc

SEQ ID NO: 736 - DNA, 392 bp, Artificial Sequence
  Description of Artificial Sequence: Synthetic polynucleotide
  gnl|Fabrus|VH1-24_IGHD5-18*01_IGHJ6*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggtggatacagctatggttacgattactactactactacggtatggacgtctgggggcaagggaccacggtcaccgtctcctcagctagc

SEQ ID NO: 737 - DNA, 380 bp, Artificial Sequence
  Description of Artificial Sequence: Synthetic polynucleotide
  gnl|Fabrus|VH1-24_IGHD6-19*01_IGHJ4*01
ccatggcacaggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagaggggtatagcagtggctggtacgactactttgactactggggccaaggaaccctggtcaccgtctcctcagctagc

SEQ ID NO: 738 - DNA, 392 bp, Artificial Sequence
  Description of Artificial Sequence: Synthetic polynucleotide
  gnl|Fabrus|VH1-3_IGHD2-15*01_IGHJ2*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtggtggtagctgctactcctactggtacttcgatctctggggccgtggcaccctggtcactgtctcctcagctagc

SEQ ID NO: 739 - DNA, 392 bp, Artificial Sequence
  Description of Artificial Sequence: Synthetic polynucleotide
  gnl|Fabrus|VH1-3_IGHD2-2*01_IGHJ5*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaaggatattgtagtagtaccagctgctatgccgacaactggttcgactcctggggccaaggaaccctggtcaccgtctcctcagctagc

SEQ ID NO: 740 - DNA, 404 bp, Artificial Sequence
  Description of Artificial Sequence: Synthetic polynucleotide
  gnl|Fabrus|VH1-3_IGHD3-9*01_IGHJ6*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagagtattacgatattttgactggttattataacgattactactactactacggtatggacgtctgggggcaagggaccacggtcaccgtctcctcagctagc

SEQ ID NO: 741 - DNA, 377 bp, Artificial Sequence
  Description of Artificial Sequence: Synthetic polynucleotide
  gnl|Fabrus|VH1-3_IGHD4-23*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagatgactacggtggtaactccgactactttgactactggggccaaggaaccctggtcaccgtctcctcagctagc

SEQ ID NO: 742 - DNA, 377 bp, Artificial Sequence
  Description of Artificial Sequence: Synthetic polynucleotide
  gnl|Fabrus|VH1-3_IGHD5-18*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagaggtggatacagctatggttacgactactttgactactggggccaaggaaccctggtcaccgtctcctcagctagc

SEQ ID NO: 743 - DNA, 380 bp, Artificial Sequence
  Description of Artificial Sequence: Synthetic polynucleotide
  gnl|Fabrus|VH1-3_IGHD6-6*01_IGHJ1*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagaggagtatagcagctcgtccgctgaatacttccagcactggggccagggcaccctggtcaccgtctcctcagctagc

SEQ ID NO: 744 - DNA, 368 bp, Artificial Sequence
  Description of Artificial Sequence: Synthetic polynucleotide
  gnl|Fabrus|VH1-3_IGHD7-27*01_IGHJ4*01
ccatggcacaggttcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggagcaacgctggcaatggtaacacaaaatattcacaggagttccagggcagagtcaccattaccagggacacatccgcgagcacagcctacatggagctgagcagcctgagatctgaggacatggctgtgtattactgtgcgagagctaactggggagactactttgactactggggccaaggaaccctggtcaccgtctcctcagctagc

SEQ ID NO: 745 - DNA, 377 bp, Artificial Sequence
  Description of Artificial Sequence: Synthetic polynucleotide
  gnl|Fabrus|VH1-45_IGHD1-26*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatggtatagtgggagctactacgactactttgactactggggccaaggaaccctggtcaccgtctcctcagctagc

SEQ ID NO: 746 - DNA, 404 bp, Artificial Sequence
  Description of Artificial Sequence: Synthetic polynucleotide
  gnl|Fabrus|VH1-45_IGHD2-15*01_IGHJ6*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtagtggtggtagctgctactccgattactactactactacggtatggacgtctgggggcaagggaccacggtcaccgtctcctcagctagc

SEQ ID NO: 747 - DNA, 389 bp, Artificial Sequence
  Description of Artificial Sequence: Synthetic polynucleotide
  gnl|Fabrus|VH1-45_IGHD2-8*01_IGHJ3*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatggatattgtactaatggtgtatgctataccgatgcttttgatgtctggggccaagggacaatggtcaccgtctcttcagctagc

SEQ ID NO: 748 - DNA, 389 bp, Artificial Sequence
  Description of Artificial Sequence: Synthetic polynucleotide
  gnl|Fabrus|VH1-45_IGHD3-10*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattactatggttcggggagttattataacgactactttgactactggggccaaggaaccctggtcaccgtctcctcagctagc

SEQ ID NO: 749 - DNA, 398 bp, Artificial Sequence
  Description of Artificial Sequence: Synthetic polynucleotide
  gnl|Fabrus|VH1-45_IGHD3-16*01_IGHJ2*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatattattatgattacgtttgggggagttatgcttatacctactggtacttcgatctctggggccgtggcaccctggtcactgtctcctcagctagc

SEQ ID NO: 750 - DNA, 377 bp, Artificial Sequence
  Description of Artificial Sequence: Synthetic polynucleotide
  gnl|Fabrus|VH1-45_IGHD4-23*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgactacggtggtaactccgactactttgactactggggccaaggaaccctggtcaccgtctcctcagctagc

SEQ ID NO: 751 - DNA, 377 bp, Artificial Sequence
  Description of Artificial Sequence: Synthetic polynucleotide
  gnl|Fabrus|VH1-45_IGHD5-24*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatgtagagatggctacaattacgactactttgactactggggccaaggaaccctggtcaccgtctcctcagctagc

SEQ ID NO: 752 - DNA, 380 bp, Artificial Sequence
  Description of Artificial Sequence: Synthetic polynucleotide
  gnl|Fabrus|VH1-45_IGHD6-19*01_IGHJ4*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatatgggtatagcagtggctggtacgactactttgactactggggccaaggaaccctggtcaccgtctcctcagctagc

SEQ ID NO: 753 - DNA, 383 bp, Artificial Sequence
  Description of Artificial Sequence: Synthetic polynucleotide
  gnl|Fabrus|VH1-45_IGHD7-27*01_IGHJ6*01
ccatggcacagatgcagctggtgcagtctggggctgaggtgaagaagactgggtcctcagtgaaggtttcctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgagcacagcctacatggagctgagcagcctgagatctgaggacacagccatgtattactgtgcaagatctaactggggagattactactactactacggtatggacgtctgggggcaagggaccacggtcaccgtctcctcagctagc

SEQ ID NO: 754 - DNA, 377 bp, Artificial Sequence
  Description of Artificial Sequence: Synthetic polynucleotide
  gnl|Fabrus|VH1-46_IGHD1-26*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagggtatagtgggagctactacgactactttgactactggggccaaggaaccctggtcaccgtctcctcagctagc

SEQ ID NO: 755 - DNA, 392 bp, Artificial Sequence
  Description of Artificial Sequence: Synthetic polynucleotide
  gnl|Fabrus|VH1-46_IGHD2-15*01_IGHJ2*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaaggatattgtagtggtggtagctgctactcctactggtacttcgatctctggggccgtggcaccctggtcactgtctcctcagctagc

SEQ ID NO: 756 - DNA, 389 bp, Artificial Sequence
  Description of Artificial Sequence: Synthetic polynucleotide
  gnl|Fabrus|VH1-46_IGHD3-10*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagagtattactatggttcggggagttattataacgactactttgactactggggccaaggaaccctggtcaccgtctcctcagctagc

SEQ ID NO: 757 - DNA, 374 bp, Artificial Sequence
  Description of Artificial Sequence: Synthetic polynucleotide
  gnl|Fabrus|VH1-46_IGHD4-17*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatgactacggtgactacgactactttgactactggggccaaggaaccctggtcaccgtctcctcagctagc

SEQ ID NO: 758 - DNA, 377 bp, Artificial Sequence
  Description of Artificial Sequence: Synthetic polynucleotide
  gnl|Fabrus|VH1-46_IGHD5-18*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggtggatacagctatggttacgactactttgactactggggccaaggaaccctggtcaccgtctcctcagctagc

SEQ ID NO: 759 - DNA, 380 bp, Artificial Sequence
  Description of Artificial Sequence: Synthetic polynucleotide
  gnl|Fabrus|VH1-46_IGHD6-13*01_IGHJ4*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggggtatagcagcagctggtacgactactttgactactggggccaaggaaccctggtcaccgtctcctcagctagc

SEQ ID NO: 760 - DNA, 380 bp, Artificial Sequence
  Description of Artificial Sequence: Synthetic polynucleotide
  gnl|Fabrus|VH1-46_IGHD6-6*01_IGHJ1*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagaggagtatagcagctcgtccgctgaatacttccagcactggggccagggcaccctggtcaccgtctcctcagctagc

SEQ ID NO: 761 - DNA, 371 bp, Artificial Sequence
  Description of Artificial Sequence: Synthetic polynucleotide
  gnl|Fabrus|VH1-46_IGHD7-27*01_IGHJ2*01
ccatggcacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagctaactggggatactggtacttcgatctctggggccgtggcaccctggtcactgtctcctcagctagc

SEQ ID NO: 762 - DNA, 377 bp, Artificial Sequence
  Description of Artificial Sequence: Synthetic polynucleotide
  gnl|Fabrus|VH1-58_IGHD1-26*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagggtatagtgggagctactacgactactttgactactggggccaaggaaccctggtcaccgtctcctcagctagc

SEQ ID NO: 763 - DNA, 392 bp, Artificial Sequence
  Description of Artificial Sequence: Synthetic polynucleotide
  gnl|Fabrus|VH1-58_IGHD2-15*01_IGHJ2*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaaggatattgtagtggtggtagctgctactcctactggtacttcgatctctggggccgtggcaccctggtcactgtctcctcagctagc

SEQ ID NO: 764 - DNA, 404 bp, Artificial Sequence
  Description of Artificial Sequence: Synthetic polynucleotide
  gnl|Fabrus|VH1-58_IGHD3-10*01_IGHJ6*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagagtattactatggttcggggagttattataacgattactactactactacggtatggacgtctgggggcaagggaccacggtcaccgtctcctcagctagc

SEQ ID NO: 765 - DNA, 374 bp, Artificial Sequence
  Description of Artificial Sequence: Synthetic polynucleotide
  gnl|Fabrus|VH1-58_IGHD4-17*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagatgactacggtgactacgactactttgactactggggccaaggaaccctggtcaccgtctcctcagctagc

SEQ ID NO: 766 - DNA, 377 bp, Artificial Sequence
  Description of Artificial Sequence: Synthetic polynucleotide
  gnl|Fabrus|VH1-58_IGHD5-18*01_IGHJ4*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcaggtggatacagctatggttacgactactttgactactggggccaaggaaccctggtcaccgtctcctcagctagc

SEQ ID NO: 767 - DNA, 380 bp, Artificial Sequence
  Description of Artificial Sequence: Synthetic polynucleotide
  gnl|Fabrus|VH1-58_IGHD6-6*01_IGHJ1*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagaggagtatagcagctcgtccgctgaatacttccagcactggggccagggcaccctggtcaccgtctcctcagctagc

SEQ ID NO: 768 - DNA, 371 bp, Artificial Sequence
  Description of Artificial Sequence: Synthetic polynucleotide
  gnl|Fabrus|VH1-58_IGHD7-27*01_IGHJ5*01
ccatggcacaaatgcagctggtgcagtctgggcctgaggtgaagaagcctgggacctcagtgaaggtctcctgcaaggcttctggattcacctttactagctctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcagctaactggggagacaactggttcgactcctggggccaaggaaccctggtcaccgtctcctcagctagc

SEQ ID NO: 769 - DNA, 389 bp, Artificial Sequence
  Description of Artificial Sequence: Synthetic polynucleotide
  gnl|Fabrus|VH1-69_IGHD1-1*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtacaactggaacgacgattactactactactacggtatggacgtctgggggcaagggaccacggtcaccgtctcctcagctagc

SEQ ID NO: 770 - DNA, 374 bp, Artificial Sequence
  Description of Artificial Sequence: Synthetic polynucleotide
  gnl|Fabrus|VH1-69_IGHD1-14*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagggtataaccggaaccacgactactttgactactggggccaaggaaccctggtcaccgtctcctcagctagc

SEQ ID NO: 771 - DNA, 389 bp, Artificial Sequence
  Description of Artificial Sequence: Synthetic polynucleotide
  gnl|Fabrus|VH1-69_IGHD2-2*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtagtagtaccagctgctatgccgactactttgactactggggccaaggaaccctggtcaccgtctcctcagctagc

SEQ ID NO: 772 - DNA, 404 bp, Artificial Sequence
  Description of Artificial Sequence: Synthetic polynucleotide
  gnl|Fabrus|VH1-69_IGHD2-8*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaaggatattgtactaatggtgtatgctataccgattactactactactacggtatggacgtctgggggcaagggaccacggtcaccgtctcctcagctagc

SEQ ID NO: 773 - DNA, 395 bp, Artificial Sequence
  Description of Artificial Sequence: Synthetic polynucleotide
  gnl|Fabrus|VH1-69_IGHD3-16*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattatgattacgtttgggggagttatgcttataccgactactttgactactggggccaaggaaccctggtcaccgtctcctcagctagc

SEQ ID NO: 774 - DNA, 389 bp, Artificial Sequence
  Description of Artificial Sequence: Synthetic polynucleotide
  gnl|Fabrus|VH1-69_IGHD3-3*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatttttggagtggttattataccgactactttgactactggggccaaggaaccctggtcaccgtctcctcagctagc

SEQ ID NO: 775 - DNA, 404 bp, Artificial Sequence
  Description of Artificial Sequence: Synthetic polynucleotide
  gnl|Fabrus|VH1-69_IGHD3-9*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagtattacgatattttgactggttattataacgattactactactactacggtatggacgtctgggggcaagggaccacggtcaccgtctcctcagctagc

SEQ ID NO: 776 - DNA, 374 bp, Artificial Sequence
  Description of Artificial Sequence: Synthetic polynucleotide
  gnl|Fabrus|VH1-69_IGHD4-17*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagatgactacggtgactacgactactttgactactggggccaaggaaccctggtcaccgtctcctcagctagc

SEQ ID NO: 777 - DNA, 380 bp, Artificial Sequence
  Description of Artificial Sequence: Synthetic polynucleotide
  gnl|Fabrus|VH1-69_IGHD5-12*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtggatatagtggctacgattacgactactttgactactggggccaaggaaccctggtcaccgtctcctcagctagc

SEQ ID NO: 778 - DNA, 392 bp, Artificial Sequence
  Description of Artificial Sequence: Synthetic polynucleotide
  gnl|Fabrus|VH1-69_IGHD5-24*01_IGHJ6*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaggtagagatggctacaattacgattactactactactacggtatggacgtctgggggcaagggaccacggtcaccgtctcctcagctagc

SEQ ID NO: 779 - DNA, 380 bp, Artificial Sequence
  Description of Artificial Sequence: Synthetic polynucleotide
  gnl|Fabrus|VH1-69_IGHD6-19*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggggtatagcagtggctggtacgactactttgactactggggccaaggaaccctggtcaccgtctcctcagctagc

SEQ ID NO: 780 - DNA, 380 bp, Artificial Sequence
  Description of Artificial Sequence: Synthetic polynucleotide
  gnl|Fabrus|VH1-69_IGHD6-6*01_IGHJ1*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagaggagtatagcagctcgtccgctgaatacttccagcactggggccagggcaccctggtcaccgtctcctcagctagc

SEQ ID NO: 781 - DNA, 368 bp, Artificial Sequence
  Description of Artificial Sequence: Synthetic polynucleotide
  gnl|Fabrus|VH1-69_IGHD7-27*01_IGHJ4*01
ccatggcacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagagctaactggggactactttgactactggggccaaggaaccctggtcaccgtctcctcagctagc

SEQ ID NO: 782 - DNA, 377 bp, Artificial Sequence
  Description of Artificial Sequence: Synthetic polynucleotide
  gnl|Fabrus|VH1-8_IGHD1-26*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtatagtgggagctactacgactactttgactactggggccaaggaaccctggtcaccgtctcctcagctagc

SEQ ID NO: 783 - DNA, 404 bp, Artificial Sequence
  Description of Artificial Sequence: Synthetic polynucleotide
  gnl|Fabrus|VH1-8_IGHD2-15*01_IGHJ6*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtggtggtagctgctactccgattactactactactacggtatggacgtctgggggcaagggaccacggtcaccgtctcctcagctagc

SEQ ID NO: 784 - DNA, 404 bp, Artificial Sequence
  Description of Artificial Sequence: Synthetic polynucleotide
  gnl|Fabrus|VH1-8_IGHD2-2*01_IGHJ6*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggaggatattgtagtagtaccagctgctatgccgattactactactactacggtatggacgtctgggggcaagggaccacggtcaccgtctcctcagctagc

SEQ ID NO: 785 - DNA, 389 bp, Artificial Sequence
  Description of Artificial Sequence: Synthetic polynucleotide
  gnl|Fabrus|VH1-8_IGHD3-10*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagggtattactatggttcggggagttattataacgactactttgactactggggccaaggaaccctggtcaccgtctcctcagctagc

SEQ ID NO: 786 - DNA, 374 bp, Artificial Sequence
  Description of Artificial Sequence: Synthetic polynucleotide
  gnl|Fabrus|VH1-8_IGHD4-17*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtgactacggtgactacgactactttgactactggggccaaggaaccctggtcaccgtctcctcagctagc

SEQ ID NO: 787 - DNA, 377 bp, Artificial Sequence
  Description of Artificial Sequence: Synthetic polynucleotide
  gnl|Fabrus|VH1-8_IGHD5-5*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggtggatacagctatggttacgactactttgactactggggccaaggaaccctggtcaccgtctcctcagctagc

SEQ ID NO: 788 - DNA, 368 bp, Artificial Sequence
  Description of Artificial Sequence: Synthetic polynucleotide
  gnl|Fabrus|VH1-8_IGHD7-27*01_IGHJ4*01
ccatggcacaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagctaactggggagactactttgactactggggccaaggaaccctggtcaccgtctcctcagctagc

SEQ ID NO: 789 - DNA, 380 bp, Artificial Sequence
  Description of Artificial Sequence: Synthetic polynucleotide
  gnl|Fabrus|VH2-26_IGHD1-20*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtataactggaacgacgactactttgactactggggccaaggaaccctggtcaccgtctcctcagctagc

SEQ ID NO: 790 - DNA, 398 bp, Artificial Sequence
  Description of Artificial Sequence: Synthetic polynucleotide
  gnl|Fabrus|VH2-26_IGHD2-15*01_IGHJ2*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtggtggtagctgctactcctactggtacttcgatctctggggccgtggcaccctggtcactgtctcctcagctagc

SEQ ID NO: 791 - DNA, 395 bp, Artificial Sequence
  Description of Artificial Sequence: Synthetic polynucleotide
  gnl|Fabrus|VH2-26_IGHD2-2*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgaggatattgtagtagtaccagctgctatgccgactactttgactactggggccaaggaaccctggtcaccgtctcctcagctagc

SEQ ID NO: 792 - DNA, 395 bp, Artificial Sequence
  Description of Artificial Sequence: Synthetic polynucleotide
  gnl|Fabrus|VH2-26_IGHD3-10*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattactatggttcggggagttattataacgactactttgactactggggccaaggaaccctggtcaccgtctcctcagctagc

SEQ ID NO: 793 - DNA, 410 bp, Artificial Sequence
  Description of Artificial Sequence: Synthetic polynucleotide
  gnl|Fabrus|VH2-26_IGHD3-9*01_IGHJ6*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacggtattacgatattttgactggttattataacgattactactactactacggtatggacgtctgggggcaagggaccacggtcaccgtctcctcagctagc

SEQ ID NO: 794 - DNA, 380 bp, Artificial Sequence
  Description of Artificial Sequence: Synthetic polynucleotide
  gnl|Fabrus|VH2-26_IGHD4-11*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtgactacagtaactacgactactttgactactggggccaaggaaccctggtcaccgtctcctcagctagc

SEQ ID NO: 795 - DNA, 386 bp, Artificial Sequence
  Description of Artificial Sequence: Synthetic polynucleotide
  gnl|Fabrus|VH2-26_IGHD5-12*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatatagtggctacgattacgactactttgactactggggccaaggaaccctggtcaccgtctcctcagctagc

SEQ ID NO: 796 - DNA, 383 bp, Artificial Sequence
  Description of Artificial Sequence: Synthetic polynucleotide
  gnl|Fabrus|VH2-26_IGHD5-18*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacgtggatacagctatggttacgactactttgactactggggccaaggaaccctggtcaccgtctcctcagctagc

SEQ ID NO: 797 - DNA, 383 bp, Artificial Sequence
  Description of Artificial Sequence: Synthetic polynucleotide
  gnl|Fabrus|VH2-26_IGHD6-13*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatagggtatagcagcagctggtacgactactttgactactggggccaaggaaccctggtcaccgtctcctcagctagc

SEQ ID NO: 798 - DNA, 371 bp, Artificial Sequence
  Description of Artificial Sequence: Synthetic polynucleotide
  gnl|Fabrus|VH2-26_IGHD7-27*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatactaactggggactactttgactactggggccaaggaaccctggtcaccgtctcctcagctagc

SEQ ID NO: 799 - DNA, 374 bp, Artificial Sequence
  Description of Artificial Sequence: Synthetic polynucleotide
  gnl|Fabrus|VH2-26_IGHD7-27*01_IGHJ4*01
ccatggcacaggtcaccttgaaggagtctggtcctgtgctggtgaaacccacagagaccctcacgctgacctgcaccgtctctgggttctcactcagcaatgctagaatgggtgtgagctggattcgtcagcccccagggaaggccctggagtggcttgcacacattttttcgaatgacgaaaaatcctacagcacatctctgaagagcaggctcaccatctccaaggacacctccaaaagccaggtggtccttaccatgaccaacatggaccctgtggacacagccacatattactgtgcacggatacctaactggggagactactttgactactggggccaaggaaccctggtcaccgtctcctcagctagc

SEQ ID NO: 800 - DNA, 383 bp, Artificial Sequence
  Description of Artificial Sequence: Synthetic polynucleotide
  gnl|Fabrus|VH2-5_IGHD1-1*01_IGHJ5*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtacaactggaacgacgacaactggttcgactcctggggccaaggaaccctggtcaccgtctcctcagctagc

SEQ ID NO: 801 - DNA, 410 bp, Artificial Sequence
  Description of Artificial Sequence: Synthetic polynucleotide
  gnl|Fabrus|VH2-5_IGHD2-15*01_IGHJ6*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgaggatattgtagtggtggtagctgctactccgattactactactactacggtatggacgtctgggggcaagggaccacggtcaccgtctcctcagctagc

SEQ ID NO: 802 - DNA, 401 bp, Artificial Sequence
  Description of Artificial Sequence: Synthetic polynucleotide
  gnl|Fabrus|VH2-5_IGHD3-16*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattatgattacgtttgggggagttatgcttataccgactactttgactactggggccaaggaaccctggtcaccgtctcctcagctagc

SEQ ID NO: 803 - DNA, 410 bp, Artificial Sequence
  Description of Artificial Sequence: Synthetic polynucleotide
  gnl|Fabrus|VH2-5_IGHD3-9*01_IGHJ6*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacggtattacgatattttgactggttattataacgattactactactactacggtatggacgtctgggggcaagggaccacggtcaccgtctcctcagctagc

SEQ ID NO: 804 - DNA, 386 bp, Artificial Sequence
  Description of Artificial Sequence: Synthetic polynucleotide
  gnl|Fabrus|VH2-5_IGHD5-12*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacgtggatatagtggctacgattacgactactttgactactggggccaaggaaccctggtcaccgtctcctcagctagc

SEQ ID NO: 805 - DNA, 383 bp, Artificial Sequence
  Description of Artificial Sequence: Synthetic polynucleotide
  gnl|Fabrus|VH2-5_IGHD6-13*01_IGHJ4*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagagggtatagcagcagctggtacgactactttgactactggggccaaggaaccctggtcaccgtctcctcagctagc

SEQ ID NO: 806 - DNA, 377 bp, Artificial Sequence
  Description of Artificial Sequence: Synthetic polynucleotide
  gnl|Fabrus|VH2-5_IGHD7-27*01_IGHJ2*01
ccatggcacagatcaccttgaaggagtctggtcctacgctggtgaaacccacacagaccctcacgctgacctgcaccttctctgggttctcactcagcactagtggagtgggtgtgggctggattcgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacagacctaactggggatactggtacttcgatctctggggccgtggcaccctggtcactgtctcctcagctagc

SEQ ID NO: 807 - DNA, 383 bp, Artificial Sequence
  Description of Artificial Sequence: Synthetic polynucleotide
  gnl|Fabrus|VH2-70_IGHD1-1*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtacaactggaacgactactggtacttcgatctctggggccgtggcaccctggtcactgtctcctcagctagc

SEQ ID NO: 808 - DNA, 398 bp, Artificial Sequence
  Description of Artificial Sequence: Synthetic polynucleotide
  gnl|Fabrus|VH2-70_IGHD2-15*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgaggatattgtagtggtggtagctgctactcctactggtacttcgatctctggggccgtggcaccctggtcactgtctcctcagctagc

SEQ ID NO: 809 - DNA, 395 bp, Artificial Sequence
  Description of Artificial Sequence: Synthetic polynucleotide
  gnl|Fabrus|VH2-70_IGHD3-22*01_IGHJ4*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattactatgatagtagtggttattactacgactactttgactactggggccaaggaaccctggtcaccgtctcctcagctagc

SEQ ID NO: 810 - DNA, 410 bp, Artificial Sequence
  Description of Artificial Sequence: Synthetic polynucleotide
  gnl|Fabrus|VH2-70_IGHD3-9*01_IGHJ6*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacggtattacgatattttgactggttattataacgattactactactactacggtatggacgtctgggggcaagggaccacggtcaccgtctcctcagctagc

SEQ ID NO: 811 - DNA, 386 bp, Artificial Sequence
  Description of Artificial Sequence: Synthetic polynucleotide
  gnl|Fabrus|VH2-70_IGHD5-12*01_IGHJ4*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacgtggatatagtggctacgattacgactactttgactactggggccaaggaaccctggtcaccgtctcctcagctagc

SEQ ID NO: 812 - DNA, 377 bp, Artificial Sequence
  Description of Artificial Sequence: Synthetic polynucleotide
  gnl|Fabrus|VH2-70_IGHD7-27*01_IGHJ2*01
ccatggcacaggtcaccttgagggagtctggtcctgcgctggtgaaacccacacagaccctcacactgacctgcaccttctctgggttctcactcagcactagtggaatgtgtgtgagctggattcgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattattgtgcacggatacctaactggggatactggtacttcgatctctggggccgtggcaccctggtcactgtctcctcagctagc

SEQ ID NO: 813 - DNA, 377 bp, Artificial Sequence
  Description of Artificial Sequence: Synthetic polynucleotide
  gnl|Fabrus|VH3-11_IGHD1-26*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagggtatagtgggagctactacgactactttgactactggggccaaggaaccctggtcaccgtctcctcagctagc

SEQ ID NO: 814 - DNA, 404 bp, Artificial Sequence
  Description of Artificial Sequence: Synthetic polynucleotide
  gnl|Fabrus|VH3-11_IGHD2-2*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaaggatattgtagtagtaccagctgctatgccgattactactactactacggtatggacgtctgggggcaagggaccacggtcaccgtctcctcagctagc

SEQ ID NO: 815 - DNA, 395 bp, Artificial Sequence
  Description of Artificial Sequence: Synthetic polynucleotide
  gnl|Fabrus|VH3-11_IGHD3-16*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattatgattacgtttgggggagttatgcttataccgactactttgactactggggccaaggaaccctggtcaccgtctcctcagctagc

SEQ ID NO: 816 - DNA, 404 bp, Artificial Sequence
  Description of Artificial Sequence: Synthetic polynucleotide
  gnl|Fabrus|VH3-11_IGHD3-9*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagtattacgatattttgactggttattataacgattactactactactacggtatggacgtctgggggcaagggaccacggtcaccgtctcctcagctagc

SEQ ID NO: 817 - DNA, 380 bp, Artificial Sequence
  Description of Artificial Sequence: Synthetic polynucleotide
  gnl|Fabrus|VH3-11_IGHD4-23*01_IGHJ5*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagatgactacggtggtaactccgacaactggttcgactcctggggccaaggaaccctggtcaccgtctcctcagctagc

SEQ ID NO: 818 - DNA, 377 bp, Artificial Sequence
  Description of Artificial Sequence: Synthetic polynucleotide
  gnl|Fabrus|VH3-11_IGHD5-18*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagaggtggatacagctatggttacgactactttgactactggggccaaggaaccctggtcaccgtctcctcagctagc

SEQ ID NO: 819 - DNA, 395 bp, Artificial Sequence
  Description of Artificial Sequence: Synthetic polynucleotide
  gnl|Fabrus|VH3-11_IGHD6-19*01_IGHJ6*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggggtatagcagtggctggtacgattactactactactacggtatggacgtctgggggcaagggaccacggtcaccgtctcctcagctagc

SEQ ID NO: 820 - DNA, 380 bp, Artificial Sequence
  Description of Artificial Sequence: Synthetic polynucleotide
  gnl|Fabrus|VH3-11_IGHD6-6*01_IGHJ1*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaggagtatagcagctcgtccgctgaatacttccagcactggggccagggcaccctggtcaccgtctcctcagctagc

SEQ ID NO: 821 - DNA, 368 bp, Artificial Sequence
  Description of Artificial Sequence: Synthetic polynucleotide
  gnl|Fabrus|VH3-11_IGHD7-27*01_IGHJ4*01
ccatggcacaggtgcagctggtggagtctgggggaggcttggtcaagcctggagggtccctgagactctcctgtgcagcctctggattcaccttcagtgactactacatgagctggattcgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagagctaactggggactactttgactactggggccaaggaaccctggtcaccgtctcctcagctagc

SEQ ID NO: 822 - DNA, 374 bp, Artificial Sequence
  Description of Artificial Sequence: Synthetic polynucleotide
  gnl|Fabrus|VH3-13_IGHD1-26*01_IGHJ4*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagggtatagtgggagctactacgactactttgactactggggccaaggaaccctggtcaccgtctcctcagctagc

SEQ ID NO: 823 - DNA, 389 bp, Artificial Sequence
  Description of Artificial Sequence: Synthetic polynucleotide
  gnl|Fabrus|VH3-13_IGHD2-8*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaaggatattgtactaatggtgtatgctataccgacaactggttcgactcctggggccaaggaaccctggtcaccgtctcctcagctagc

SEQ ID NO: 824 - DNA, 389 bp, Artificial Sequence
  Description of Artificial Sequence: Synthetic polynucleotide
  gnl|Fabrus|VH3-13_IGHD3-3*01_IGHJ1*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatttttggagtggttattataccgctgaatacttccagcactggggccagggcaccctggtcaccgtctcctcagctagc

SEQ ID NO: 825 - DNA, 401 bp, Artificial Sequence
  Description of Artificial Sequence: Synthetic polynucleotide
  gnl|Fabrus|VH3-13_IGHD3-9*01_IGHJ6*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagagtattacgatattttgactggttattataacgattactactactactacggtatggacgtctgggggcaagggaccacggtcaccgtctcctcagctagc

SEQ ID NO: 826 - DNA, 377 bp, Artificial Sequence
  Description of Artificial Sequence: Synthetic polynucleotide
  gnl|Fabrus|VH3-13_IGHD4-23*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagatgactacggtggtaactccgacaactggttcgactcctggggccaaggaaccctggtcaccgtctcctcagctagc

SEQ ID NO: 827 - DNA, 374 bp, Artificial Sequence
  Description of Artificial Sequence: Synthetic polynucleotide
  gnl|Fabrus|VH3-13_IGHD5-5*01_IGHJ4*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagaggtggatacagctatggttacgactactttgactactggggccaaggaaccctggtcaccgtctcctcagctagc

SEQ ID NO: 828 - DNA, 377 bp, Artificial Sequence
  Description of Artificial Sequence: Synthetic polynucleotide
  gnl|Fabrus|VH3-13_IGHD6-6*01_IGHJ1*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagaggagtatagcagctcgtccgctgaatacttccagcactggggccagggcaccctggtcaccgtctcctcagctagc

SEQ ID NO: 829 - DNA, 368 bp, Artificial Sequence
  Description of Artificial Sequence: Synthetic polynucleotide
  gnl|Fabrus|VH3-13_IGHD7-27*01_IGHJ5*01
ccatggcagaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagctaactggggagacaactggttcgactcctggggccaaggaaccctggtcaccgtctcctcagctagc

SEQ ID NO: 830 - DNA, 383 bp, Artificial Sequence
  Description of Artificial Sequence: Synthetic polynucleotide
  gnl|Fabrus|VH3-15_IGHD1-26*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagggtatagtgggagctactacgactactttgactactggggccaaggaaccctggtcaccgtctcctcagctagc

SEQ ID NO: 831 - DNA, 398 bp, Artificial Sequence
  Description of Artificial Sequence: Synthetic polynucleotide
  gnl|Fabrus|VH3-15_IGHD2-15*01_IGHJ2*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactcctactggtacttcgatctctggggccgtggcaccctggtcactgtctcctcagctagc

SEQ ID NO: 832 - DNA, 410 bp, Artificial Sequence
  Description of Artificial Sequence: Synthetic polynucleotide
  gnl|Fabrus|VH3-15_IGHD2-15*01_IGHJ6*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaaggatattgtagtggtggtagctgctactccgattactactactactacggtatggacgtctgggggcaagggaccacggtcaccgtctcctcagctagc

SEQ ID NO: 833 - DNA, 395 bp, Artificial Sequence
  Description of Artificial Sequence: Synthetic polynucleotide
  gnl|Fabrus|VH3-15_IGHD3-10*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattactatggttcggggagttattataacgactactttgactactggggccaaggaaccctggtcaccgtctcctcagctagc

SEQ ID NO: 834 - DNA, 398 bp, Artificial Sequence
  Description of Artificial Sequence: Synthetic polynucleotide
  gnl|Fabrus|VH3-15_IGHD3-9*01_IGHJ2*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagagtattacgatattttgactggttattataactactggtacttcgatctctggggccgtggcaccctggtcactgtctcctcagctagc

SEQ ID NO: 835 - DNA, 386 bp, Artificial Sequence
  Description of Artificial Sequence: Synthetic polynucleotide
  gnl|Fabrus|VH3-15_IGHD5-12*01_IGHJ4*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacaggtggatatagtggctacgattacgactactttgactactggggccaaggaaccctggtcaccgtctcctcagctagc

SEQ ID NO: 836 - DNA, 386 bp, Artificial Sequence
  Description of Artificial Sequence: Synthetic polynucleotide
  gnl|Fabrus|VH3-15_IGHD6-6*01_IGHJ1*01
ccatggcagaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaggagtatagcagctcgtccgctgaatacttccagcactggggccagggcaccctggtcaccgtctcctcagctagc

SEQ ID NO: 837 - DNA, 377 bp, Artificial Sequence
  Description of Artificial Sequence: Synthetic polynucleotide
  gnl|Fabrus|VH3-16_IGHD1-1*01_IGHJ1*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtacaactggaacgacgctgaatacttccagcactggggccagggcaccctggtcaccgtctcctcagctagc

SEQ ID NO: 838 - DNA, 389 bp, Artificial Sequence
  Description of Artificial Sequence: Synthetic polynucleotide
  gnl|Fabrus|VH3-16_IGHD1-7*01_IGHJ6*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaggtataactggaactacgattactactactactacggtatggacgtctgggggcaagggaccacggtcaccgtctcctcagctagc

SEQ ID NO: 839 - DNA, 392 bp, Artificial Sequence
  Description of Artificial Sequence: Synthetic polynucleotide
  gnl|Fabrus|VH3-16_IGHD2-15*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtggtggtagctgctactcctactggtacttcgatctctggggccgtggcaccctggtcactgtctcctcagctagc

SEQ ID NO: 840 - DNA, 392 bp, Artificial Sequence
  Description of Artificial Sequence: Synthetic polynucleotide
  gnl|Fabrus|VH3-16_IGHD2-2*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaaggatattgtagtagtaccagctgctatgcctactggtacttcgatctctggggccgtggcaccctggtcactgtctcctcagctagc

SEQ ID NO: 841 - DNA, 389 bp, Artificial Sequence
  Description of Artificial Sequence: Synthetic polynucleotide
  gnl|Fabrus|VH3-16_IGHD3-10*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaagtattactatggttcggggagttattataacgactactttgactactggggccaaggaaccctggtcaccgtctcctcagctagc

SEQ ID NO: 842 - DNA, 377 bp, Artificial Sequence
  Description of Artificial Sequence: Synthetic polynucleotide
  gnl|Fabrus|VH3-16_IGHD4-4*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaatgactacagtaactactactggtacttcgatctctggggccgtggcaccctggtcactgtctcctcagctagc

SEQ ID NO: 843 - DNA, 377 bp, Artificial Sequence
  Description of Artificial Sequence: Synthetic polynucleotide
  gnl|Fabrus|VH3-16_IGHD5-24*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaagtagagatggctacaattacgactactttgactactggggccaaggaaccctggtcaccgtctcctcagctagc

SEQ ID NO: 844 - DNA, 380 bp, Artificial Sequence
  Description of Artificial Sequence: Synthetic polynucleotide
  gnl|Fabrus|VH3-16_IGHD6-13*01_IGHJ4*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaaaggggtatagcagcagctggtacgactactttgactactggggccaaggaaccctggtcaccgtctcctcagctagc

SEQ ID NO: 845 - DNA, 371 bp, Artificial Sequence
  Description of Artificial Sequence: Synthetic polynucleotide
  gnl|Fabrus|VH3-16_IGHD7-27*01_IGHJ2*01
ccatggcagaggtgcagctggtggagtctgggggaggcttggtacagcctggggggtccctgagactctcctgtgcagcctctggattcaccttcagtaacagtgacatgaactgggcccgcaaggctccaggaaaggggctggagtgggtatcgggtgttagttggaatggcagtaggacgcactatgtggactccgtgaagcgccgattcatcatctccagagacaattccaggaactccctgtatctgcaaaagaacagacggagagccgaggacatggctgtgtattactgtgtgagaactaactggggatactggtacttcgatctctggggccgtggcaccctggtcactgtctcctcagctagc

SEQ ID NO: 846 - DNA, 374 bp, Artificial Sequence
  Description of Artificial Sequence: Synthetic polynucleotide
  gnl|Fabrus|VH3-20_IGHD1-14*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagggtataaccggaaccacgactactttgactactggggccaaggaaccctggtcaccgtctcctcagctagc

SEQ ID NO: 847 - DNA, 392 bp, Artificial Sequence
  Description of Artificial Sequence: Synthetic polynucleotide
  gnl|Fabrus|VH3-20_IGHD2-15*01_IGHJ2*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaaggatattgtagtggtggtagctgctactcctactggtacttcgatctctggggccgtggcaccctggtcactgtctcctcagctagc

SEQ ID NO: 848 - DNA, 386 bp, Artificial Sequence
  Description of Artificial Sequence: Synthetic polynucleotide
  gnl|Fabrus|VH3-20_IGHD2-8*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggatattgtactaatggtgtatgctatacactactttgactactggggccaaggaaccctggtcaccgtctcctcagctagc

SEQ ID NO: 849 - DNA, 389 bp, Artificial Sequence
  Description of Artificial Sequence: Synthetic polynucleotide
  gnl|Fabrus|VH3-20_IGHD3-10*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattactatggttcggggagttattataacgactactttgactactggggccaaggaaccctggtcaccgtctcctcagctagc

SEQ ID NO: 850 - DNA, 404 bp, Artificial Sequence
  Description of Artificial Sequence: Synthetic polynucleotide
  gnl|Fabrus|VH3-20_IGHD3-9*01_IGHJ6*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagagtattacgatattttgactggttattataacgattactactactactacggtatggacgtctgggggcaagggaccacggtcaccgtctcctcagctagc

SEQ ID NO: 851 - DNA, 377 bp, Artificial Sequence
  Description of Artificial Sequence: Synthetic polynucleotide
  gnl|Fabrus|VH3-20_IGHD4-23*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagatgactacggtggtaactccgactactttgactactggggccaaggaaccctggtcaccgtctcctcagctagc

SEQ ID NO: 852 - DNA, 380 bp, Artificial Sequence
  Description of Artificial Sequence: Synthetic polynucleotide
  gnl|Fabrus|VH3-20_IGHD5-12*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaggtggatatagtggctacgattacgactactttgactactggggccaaggaaccctggtcaccgtctcctcagctagc

SEQ ID NO: 853 - DNA, 380 bp, Artificial Sequence
  Description of Artificial Sequence: Synthetic polynucleotide
  gnl|Fabrus|VH3-20_IGHD6-13*01_IGHJ4*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagaggggtatagcagcagctggtacgactactttgactactggggccaaggaaccctggtcaccgtctcctcagctagc

SEQ ID NO: 854 - DNA, 371 bp, Artificial Sequence
  Description of Artificial Sequence: Synthetic polynucleotide
  gnl|Fabrus|VH3-20_IGHD7-27*01_IGHJ2*01
ccatggcagaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagagctaactggggatactggtacttcgatctctggggccgtggcaccctggtcactgtctcctcagctagc

SEQ ID NO: 855 - DNA, 377 bp, Artificial Sequence
  Description of Artificial Sequence: Synthetic polynucleotide
  gnl|Fabrus|VH3-21_IGHD1-26*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagggtatagtgggagctactacgactactttgactactggggccaaggaaccctggtcaccgtctcctcagctagc

SEQ ID NO: 856 - DNA, 392 bp, Artificial Sequence
  Description of Artificial Sequence: Synthetic polynucleotide
  gnl|Fabrus|VH3-21_IGHD2-2*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaaggatattgtagtagtaccagctgctatgccgacaactggttcgactcctggggccaaggaaccctggtcaccgtctcctcagctagc

SEQ ID NO: 857 - DNA, 389 bp, Artificial Sequence
  Description of Artificial Sequence: Synthetic polynucleotide
  gnl|Fabrus|VH3-21_IGHD3-22*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagagtattactatgatagtagtggttattactacgactactttgactactggggccaaggaaccctggtcaccgtctcctcagctagc

SEQ ID NO: 858 - DNA, 380 bp, Artificial Sequence
  Description of Artificial Sequence: Synthetic polynucleotide
  gnl|Fabrus|VH3-21_IGHD4-23*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagatgactacggtggtaactccgacaactggttcgactcctggggccaaggaaccctggtcaccgtctcctcagctagc

SEQ ID NO: 859 - DNA, 380 bp, Artificial Sequence
  Description of Artificial Sequence: Synthetic polynucleotide
  gnl|Fabrus|VH3-21_IGHD5-24*01_IGHJ5*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggtagagatggctacaattacgacaactggttcgactcctggggccaaggaaccctggtcaccgtctcctcagctagc

SEQ ID NO: 860 - DNA, 383 bp, Artificial Sequence
  Description of Artificial Sequence: Synthetic polynucleotide
  gnl|Fabrus|VH3-21_IGHD6-19*01_IGHJ1*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagaggggtatagcagtggctggtacgctgaatacttccagcactggggccagggcaccctggtcaccgtctcctcagctagc

SEQ ID NO: 861 - DNA, 368 bp, Artificial Sequence
  Description of Artificial Sequence: Synthetic polynucleotide
  gnl|Fabrus|VH3-21_IGHD7-27*01_IGHJ4*01
ccatggcagaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagctaactggggagactactttgactactggggccaaggaaccctggtcaccgtctcctcagctagc

SEQ ID NO: 862 - DNA, 377 bp, Artificial Sequence
  Description of Artificial Sequence: Synthetic polynucleotide
  gnl|Fabrus|VH3-23_IGHD1-1*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtacaactggaacgacgctgaatacttccagcactggggccagggcaccctggtcaccgtctcctcagctagc

SEQ ID NO: 863 - DNA, 374 bp, Artificial Sequence
  Description of Artificial Sequence: Synthetic polynucleotide
  gnl|Fabrus|VH3-23_IGHD1-1*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagggtacaactggaacgaactactttgactactggggccaaggaaccctggtcaccgtctcctcagctagc

SEQ ID NO: 864 - DNA, 374 bp, Artificial Sequence
  Description of Artificial Sequence: Synthetic polynucleotide
  gnl|Fabrus|VH3-23_IGHD1-20*01_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtataactggaacgacgatgcttttgatgtctggggccaagggacaatggtcaccgtctcttcagctagc

SEQ ID NO: 865 - DNA, 377 bp, Artificial Sequence
  Description of Artificial Sequence: Synthetic polynucleotide
  gnl|Fabrus|VH3-23_IGHD1-26*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagggtatagtgggagctactacgactactttgactactggggccaaggaaccctggtcaccgtctcctcagctagc

SEQ ID NO: 866 - DNA, 389 bp, Artificial Sequence
  Description of Artificial Sequence: Synthetic polynucleotide
  gnl|Fabrus|VH3-23_IGHD2-15*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaaggatattgtagtggtggtagctgctactccgactactttgactactggggccaaggaaccctggtcaccgtctcctcagctagc

SEQ ID NO: 867 - DNA, 389 bp, Artificial Sequence
  Description of Artificial Sequence: Synthetic polynucleotide
  gnl|Fabrus|VH3-23_IGHD2-21*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaagcatattgtggtggtgattgctattccgctgaatacttccagcactggggccagggcaccctggtcaccgtctcctcagctagc

SEQ ID NO: 868 - DNA, 389 bp, Artificial Sequence
  Description of Artificial Sequence: Synthetic polynucleotide
  gnl|Fabrus|VH3-23_IGHD3-10*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatggttcggggagttattataacgactactttgactactggggccaaggaaccctggtcaccgtctcctcagctagc

SEQ ID NO: 869 - DNA, 395 bp, Artificial Sequence
  Description of Artificial Sequence: Synthetic polynucleotide
  gnl|Fabrus|VH3-23_IGHD3-16*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattatgattacgtttgggggagttatgcttataccgactactttgactactggggccaaggaaccctggtcaccgtctcctcagctagc

SEQ ID NO: 870 - DNA, 389 bp, Artificial Sequence
  Description of Artificial Sequence: Synthetic polynucleotide
  gnl|Fabrus|VH3-23_IGHD3-22*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattactatgatagtagtggttattactacgactactttgactactggggccaaggaaccctggtcaccgtctcctcagctagc

SEQ ID NO: 871 - DNA, 392 bp, Artificial Sequence
  Description of Artificial Sequence: Synthetic polynucleotide
  gnl|Fabrus|VH3-23_IGHD3-3*01_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagagtattacgatttttggagtggttattataccgacaactggttcgactcctggggccaaggaaccctggtcaccgtctcctcagctagc

SEQ ID NO: 872 - DNA, 374 bp, Artificial Sequence
  Description of Artificial Sequence: Synthetic polynucleotide
  gnl|Fabrus|VH3-23_IGHD4-11*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacagtaactacgactactttgactactggggccaaggaaccctggtcaccgtctcctcagctagc

SEQ ID NO: 873 - DNA, 380 bp, Artificial Sequence
  Description of Artificial Sequence: Synthetic polynucleotide
  gnl|Fabrus|VH3-23_IGHD4-23*01_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatgactacggtggtaactcctactggtacttcgatctctggggccgtggcaccctggtcactgtctcctcagctagc

SEQ ID NO: 874 - DNA, 380 bp, Artificial Sequence
  Description of Artificial Sequence: Synthetic polynucleotide
  gnl|Fabrus|VH3-23_IGHD5-12*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatatagtggctacgattacgactactttgactactggggccaaggaaccctggtcaccgtctcctcagctagc

SEQ ID NO: 875 - DNA, 380 bp, Artificial Sequence
  Description of Artificial Sequence: Synthetic polynucleotide
  gnl|Fabrus|VH3-23_IGHD5-24*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtagagatggctacaattacgctgaatacttccagcactggggccagggcaccctggtcaccgtctcctcagctagc

SEQ ID NO: 876 - DNA, 377 bp, Artificial Sequence
  Description of Artificial Sequence: Synthetic polynucleotide
  gnl|Fabrus|VH3-23_IGHD5-5*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggtggatacagctatggttacgactactttgactactggggccaaggaaccctggtcaccgtctcctcagctagc

SEQ ID NO: 877 - DNA, 380 bp, Artificial Sequence
  Description of Artificial Sequence: Synthetic polynucleotide
  gnl|Fabrus|VH3-23_IGHD6-13*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcagctggtacgactactttgactactggggccaaggaaccctggtcaccgtctcctcagctagc

SEQ ID NO: 878 - DNA, 380 bp, Artificial Sequence
  Description of Artificial Sequence: Synthetic polynucleotide
  gnl|Fabrus|VH3-23_IGHD6-25*01_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggggtatagcagcggctactactggtacttcgatctctggggccgtggcaccctggtcactgtctcctcagctagc

SEQ ID NO: 879 - DNA, 380 bp, Artificial Sequence
  Description of Artificial Sequence: Synthetic polynucleotide
  gnl|Fabrus|VH3-23_IGHD6-6*01_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagaggagtatagcagctcgtccgctgaatacttccagcactggggccagggcaccctggtcaccgtctcctcagctagc

SEQ ID NO: 880 - DNA, 368 bp, Artificial Sequence
  Description of Artificial Sequence: Synthetic polynucleotide
  gnl|Fabrus|VH3-23_IGHD7-27*01_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagactactttgactactggggccaaggaaccctggtcaccgtctcctcagctagc

SEQ ID NO: 881 - DNA, 383 bp, Artificial Sequence
  Description of Artificial Sequence: Synthetic polynucleotide
  gnl|Fabrus|VH3-23_IGHD7-27*01_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagctaactggggagattactactactactacggtatggacgtctgggggcaagggaccacggtcaccgtctcctcagctagc

SEQ ID NO: 882 - DNA, 389 bp, Artificial Sequence
  Description of Artificial Sequence: Synthetic polynucleotide
  gnl|Fabrus|VH3-30_IGHD1-1*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtacaactggaacgacgattactactactactacggtatggacgtctgggggcaagggaccacggtcaccgtctcctcagctagc

SEQ ID NO: 883 - DNA, 380 bp, Artificial Sequence
  Description of Artificial Sequence: Synthetic polynucleotide
  gnl|Fabrus|VH3-30_IGHD1-26*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgctgaatacttccagcactggggccagggcaccctggtcaccgtctcctcagctagc

SEQ ID NO: 884 - DNA, 377 bp, Artificial Sequence
  Description of Artificial Sequence: Synthetic polynucleotide
  gnl|Fabrus|VH3-30_IGHD1-26*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagggtatagtgggagctactacgactactttgactactggggccaaggaaccctggtcaccgtctcctcagctagc

SEQ ID NO: 885 - DNA, 392 bp, Artificial Sequence
  Description of Artificial Sequence: Synthetic polynucleotide
  gnl|Fabrus|VH3-30_IGHD2-15*01_IGHJ2*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtggtggtagctgctactcctactggtacttcgatctctggggccgtggcaccctggtcactgtctcctcagctagc

SEQ ID NO: 886 - DNA, 404 bp, Artificial Sequence
  Description of Artificial Sequence: Synthetic polynucleotide
  gnl|Fabrus|VH3-30_IGHD2-2*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaaggatattgtagtagtaccagctgctatgccgattactactactactacggtatggacgtctgggggcaagggaccacggtcaccgtctcctcagctagc

SEQ ID NO: 887 - DNA, 392 bp, Artificial Sequence
  Description of Artificial Sequence: Synthetic polynucleotide
  gnl|Fabrus|VH3-30_IGHD3-10*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtattactatggttcggggagttattataacggctgaatacttccagcactggggccagggcaccctggtcaccgtctcctcagctagc

SEQ ID NO: 888 - DNA, 410 bp, Artificial Sequence
  Description of Artificial Sequence: Synthetic polynucleotide
  gnl|Fabrus|VH3-30_IGHD3-16*01_IGHJ6*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtattatgattacgtttgggggagttatgcttataccgattactactactactacggtatggacgtctgggggcaagggaccacggtcaccgtctcctcagctagc

SEQ ID NO: 889 - DNA, 374 bp, Artificial Sequence
  Description of Artificial Sequence: Synthetic polynucleotide
  gnl|Fabrus|VH3-30_IGHD4-17*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagatgactacggtgactacgactactttgactactggggccaaggaaccctggtcaccgtctcctcagctagc

SEQ ID NO: 890 - DNA, 380 bp, Artificial Sequence
  Description of Artificial Sequence: Synthetic polynucleotide
  gnl|Fabrus|VH3-30_IGHD5-12*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaggtggatatagtggctacgattacgactactttgactactggggccaaggaaccctggtcaccgtctcctcagctagc

SEQ ID NO: 891 - DNA, 380 bp, Artificial Sequence
  Description of Artificial Sequence: Synthetic polynucleotide
  gnl|Fabrus|VH3-30_IGHD5-18*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagagtggatacagctatggttagctgaatacttccagcactggggccagggcaccctggtcaccgtctcctcagctagc

SEQ ID NO: 892 - DNA, 380 bp, Artificial Sequence
  Description of Artificial Sequence: Synthetic polynucleotide
  gnl|Fabrus|VH3-30_IGHD6-13*01_IGHJ4*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggggtatagcagcagctggtacgactactttgactactggggccaaggaaccctggtcaccgtctcctcagctagc

SEQ ID NO: 893 - DNA, 380 bp, Artificial Sequence
  Description of Artificial Sequence: Synthetic polynucleotide
  gnl|Fabrus|VH3-30_IGHD6-6*01_IGHJ1*01
ccatggcacaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagagaggagtatagcagctcgtccgctgaatacttccagcactggggccagggcaccctggtcaccgtctcctcagctagc

SEQ ID NO: 894 - DNA, 377 bp, Artificial Sequence
  Description of Artificial Sequence: Synthetic polynucleotide
  gnl|Fabrus|VH3-35_IGHD1-1*01_IGHJ2*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtacaactggaacgactactggtacttcgatctctggggccgtggcaccctggtcactgtctcctcagctagc

SEQ ID NO: 895 - DNA, 389 bp, Artificial Sequence
  Description of Artificial Sequence: Synthetic polynucleotide
  gnl|Fabrus|VH3-35_IGHD1-20*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaggtataactggaacgacgattactactactactacggtatggacgtctgggggcaagggaccacggtcaccgtctcctcagctagc

SEQ ID NO: 896 - DNA, 392 bp, Artificial Sequence
  Description of Artificial Sequence: Synthetic polynucleotide
  gnl|Fabrus|VH3-35_IGHD2-15*01_IGHJ2*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaaggatattgtagtggtggtagctgctactcctactggtacttcgatctctggggccgtggcaccctggtcactgtctcctcagctagc

SEQ ID NO: 897 - DNA, 401 bp, Artificial Sequence
  Description of Artificial Sequence: Synthetic polynucleotide
  gnl|Fabrus|VH3-35_IGHD2-21*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaagcatattgtggtggtgattgctattccgattactactactactacggtatggacgtctgggggcaagggaccacggtcaccgtctcctcagctagc

SEQ ID NO: 898 - DNA, 389 bp, Artificial Sequence
  Description of Artificial Sequence: Synthetic polynucleotide
  gnl|Fabrus|VH3-35_IGHD3-10*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattactatggttcggggagttattataacgactactttgactactggggccaaggaaccctggtcaccgtctcctcagctagc

SEQ ID NO: 899 - DNA, 404 bp, Artificial Sequence
  Description of Artificial Sequence: Synthetic polynucleotide
  gnl|Fabrus|VH3-35_IGHD3-9*01_IGHJ6*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaagtattacgatattttgactggttattataacgattactactactactacggtatggacgtctgggggcaagggaccacggtcaccgtctcctcagctagc

SEQ ID NO: 900 - DNA, 380 bp, Artificial Sequence
  Description of Artificial Sequence: Synthetic polynucleotide
  gnl|Fabrus|VH3-35_IGHD5-12*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaagtggatatagtggctacgattacgactactttgactactggggccaaggaaccctggtcaccgtctcctcagctagc

SEQ ID NO: 901 - DNA, 380 bp, Artificial Sequence
  Description of Artificial Sequence: Synthetic polynucleotide
  gnl|Fabrus|VH3-35_IGHD6-13*01_IGHJ4*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaaaggggtatagcagcagctggtacgactactttgactactggggccaaggaaccctggtcaccgtctcctcagctagc

SEQ ID NO: 902 - DNA, 371 bp, Artificial Sequence
  Description of Artificial Sequence: Synthetic polynucleotide
  gnl|Fabrus|VH3-35_IGHD7-27*01_IGHJ1*01
ccatggcagaggtgcagctggtggagtctgggggaggcttggtacagcctgggggctccctgagactctcctgtgcagcctctggattcaccttcagtaacagtgacatgaactgggtccatcaggctccaggaaaggggctggagtgggtatcgggtgttagttggaatggcagtaggacgcactatgcagactctgtgaagggccgattcatcatctccagagacaattccaggaacaccctgtatctgcaaacgaatagcctgagggccgaggacacggctgtgtattactgtgtgagaactaactggggagctgaatacttccagcactggggccagggcaccctggtcaccgtctcctcagctagc

SEQ ID NO: 903 - DNA, 371 bp, Artificial Sequence
  Description of Artificial Sequence: Synthetic polynucleotide
  gnl|Fabrus|VH3-38_IGHD1-14*01_IGHJ5*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataaccggaaccacgacaactggttcgactcctggggccaaggaaccctggtcaccgtctcctcagctagc

SEQ ID NO: 904 - DNA, 383 bp, Artificial Sequence
  Description of Artificial Sequence: Synthetic polynucleotide
  gnl|Fabrus|VH3-38_IGHD1-20*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatggtataactggaacgacgattactactactactacggtatggacgtctgggggcaagggaccacggtcaccgtctcctcagctagc

SEQ ID NO: 905 - DNA, 398 bp, Artificial Sequence
  Description of Artificial Sequence: Synthetic polynucleotide
  gnl|Fabrus|VH3-38_IGHD2-15*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtggtggtagctgctactccgattactactactactacggtatggacgtctgggggcaagggaccacggtcaccgtctcctcagctagc

SEQ ID NO: 906 - DNA, 386 bp, Artificial Sequence
  Description of Artificial Sequence: Synthetic polynucleotide
  gnl|Fabrus|VH3-38_IGHD2-2*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatggatattgtagtagtaccagctgctatgccgctgaatacttccagcactggggccagggcaccctggtcaccgtctcctcagctagc

SEQ ID NO: 907 - DNA, 383 bp, Artificial Sequence
  Description of Artificial Sequence: Synthetic polynucleotide
  gnl|Fabrus|VH3-38_IGHD3-10*01_IGHJ4*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattactatggttcggggagttattataacgactactttgactactggggccaaggaaccctggtcaccgtctcctcagctagc

SEQ ID NO: 908 - DNA, 392 bp, Artificial Sequence
  Description of Artificial Sequence: Synthetic polynucleotide
  gnl|Fabrus|VH3-38_IGHD3-16*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatattattatgattacgtttgggggagttatgcttataccgctgaatacttccagcactggggccagggcaccctggtcaccgtctcctcagctagc

SEQ ID NO: 909 - DNA, 371 bp, Artificial Sequence
  Description of Artificial Sequence: Synthetic polynucleotide
  gnl|Fabrus|VH3-38_IGHD4-17*01_IGHJ2*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgactacggtgactactactggtacttcgatctctggggccgtggcaccctggtcactgtctcctcagctagc

SEQ ID NO: 910 - DNA, 371 bp, Artificial Sequence
  Description of Artificial Sequence: Synthetic polynucleotide
  gnl|Fabrus|VH3-38_IGHD5-24*01_IGHJ3*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatgtagagatggctacaattacgatgcttttgatgtctggggccaagggacaatggtcaccgtctcttcagctagc

SEQ ID NO: 911 - DNA, 374 bp, Artificial Sequence
  Description of Artificial Sequence: Synthetic polynucleotide
  gnl|Fabrus|VH3-38_IGHD6-6*01_IGHJ1*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatatgagtatagcagctcgtccgctgaatacttccagcactggggccagggcaccctggtcaccgtctcctcagctagc

SEQ ID NO: 912 - DNA, 377 bp, Artificial Sequence
  Description of Artificial Sequence: Synthetic polynucleotide
  gnl|Fabrus|VH3-38_IGHD7-27*01_IGHJ6*01
ccatggcagaggtgcagctggtggagtctgggggaggcttggtacagcctagggggtccctgagactctcctgtgcagcctctggattcaccgtcagtagcaatgagatgagctggattcgccaggctccagggaaggggctggagtgggtctcatccattagtggtggtagcacatactacgcagactccaggaagggcagattcaccatctccagagacaattccaagaacacgctgtatcttcaaatgaacaacctgagagctgagggcacggccgtgtattactgtgccagatctaactggggagattactactactactacggtatggacgtctgggggcaagggaccacggtcaccgtctcctcagctagc

SEQ ID NO: 913 - DNA, 383 bp, Artificial Sequence
  Description of Artificial Sequence: Synthetic polynucleotide
  gnl|Fabrus|VH3-43_IGHD1-26*01_IGHJ5*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtatagtgggagctactacgacaactggttcgactcctggggccaaggaaccctggtcaccgtctcctcagctagc

SEQ ID NO: 914 - DNA, 392 bp, Artificial Sequence
  Description of Artificial Sequence: Synthetic polynucleotide
  gnl|Fabrus|VH3-43_IGHD1-7*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtataactggaactacgattactactactactacggtatggacgtctgggggcaagggaccacggtcaccgtctcctcagctagc

SEQ ID NO: 915 - DNA, 392 bp, Artificial Sequence
  Description of Artificial Sequence: Synthetic polynucleotide
  gnl|Fabrus|VH3-43_IGHD2-2*01_IGHJ3*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagaggatattgtagtagtaccagctgctatgccgatgcttttgatgtctggggccaagggacaatggtcaccgtctcttcagctagc

SEQ ID NO: 916 - DNA, 404 bp, Artificial Sequence
  Description of Artificial Sequence: Synthetic polynucleotide
  gnl|Fabrus|VH3-43_IGHD2-21*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagagcatattgtggtggtgattgctattccgattactactactactacggtatggacgtctgggggcaagggaccacggtcaccgtctcctcagctagc

SEQ ID NO: 917 - DNA, 413 bp, Artificial Sequence
  Description of Artificial Sequence: Synthetic polynucleotide
  gnl|Fabrus|VH3-43_IGHD3-16*01_IGHJ6*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattatgattacgtttgggggagttatgcttataccgattactactactactacggtatggacgtctgggggcaagggaccacggtcaccgtctcctcagctagc

SEQ ID NO: 918 - DNA, 392 bp, Artificial Sequence
  Description of Artificial Sequence: Synthetic polynucleotide
  gnl|Fabrus|VH3-43_IGHD3-22*01_IGHJ4*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagataggtattactatgatagtagtggttattactacgactactttgactactggggccaaggaaccctggtcaccgtctcctcagctagc

SEQ ID NO: 919 - DNA, 380 bp, Artificial Sequence
  Description of Artificial Sequence: Synthetic polynucleotide
  gnl|Fabrus|VH3-43_IGHD4-23*01_IGHJ3*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtgactacggtggtaactccgatgcttttgatgtctggggccaagggacaatggtcaccgtctcttcagctagc

SEQ ID NO: 920 - DNA, 383 bp, Artificial Sequence
  Description of Artificial Sequence: Synthetic polynucleotide
  gnl|Fabrus|VH3-43_IGHD5-18*01_IGHJ5*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatagtggatacagctatggttacgacaactggttcgactcctggggccaaggaaccctggtcaccgtctcctcagctagc

SEQ ID NO: 921 - DNA, 380 bp, Artificial Sequence
  Description of Artificial Sequence: Synthetic polynucleotide
  gnl|Fabrus|VH3-43_IGHD6-13*01_IGHJ4*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatgggtatagcagcagctggtacgactactttgactactggggccaaggaaccctggtcaccgtctcctcagctagc

SEQ ID NO: 922 - DNA, 374 bp, Artificial Sequence
  Description of Artificial Sequence: Synthetic polynucleotide
  gnl|Fabrus|VH3-43_IGHD7-27*01_IGHJ1*01
ccatggcagaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtgaagggccgattcaccatctccagagacaacagcaaaaactccctgtatctgcaaatgaacagtctgagaactgaggacaccgccttgtattactgtgcaaaagatactaactggggagctgaatacttccagcactggggccagggcaccctggtcaccgtctcctcagctagc

SEQ ID NO: 923 - DNA, 380 bp, Artificial Sequence
  Description of Artificial Sequence: Synthetic polynucleotide
  gnl|Fabrus|VH3-48_IGHD6-6*01_IGHJ1*01
ccatggcagaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagaggagtatagcagctcgtccgctgaatacttccagcactggggccagggcaccctggtcaccgtctcctcagctagc

SEQ ID NO: 924 - DNA, 383 bp, Artificial Sequence
  Description of Artificial Sequence: Synthetic polynucleotide
  gnl|Fabrus|VH3-49_IGHD1-26*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtatagtgggagctactacgactactttgactactggggccaaggaaccctggtcaccgtctcctcagctagc

SEQ ID NO: 925 - DNA, 395 bp, Artificial Sequence
  Description of Artificial Sequence: Synthetic polynucleotide
  gnl|Fabrus|VH3-49_IGHD1-7*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggtataactggaactacgattactactactactacggtatggacgtctgggggcaagggaccacggtcaccgtctcctcagctagc

SEQ ID NO: 926 - DNA, 410 bp, Artificial Sequence
  Description of Artificial Sequence: Synthetic polynucleotide
  gnl|Fabrus|VH3-49_IGHD2-2*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtagtagtaccagctgctatgccgattactactactactacggtatggacgtctgggggcaagggaccacggtcaccgtctcctcagctagc

SEQ ID NO: 927 - DNA, 395 bp, Artificial Sequence
  Description of Artificial Sequence: Synthetic polynucleotide
  gnl|Fabrus|VH3-49_IGHD2-8*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaaggatattgtactaatggtgtatgctataccgactactttgactactggggccaaggaaccctggtcaccgtctcctcagctagc

SEQ ID NO: 928 - DNA, 395 bp, Artificial Sequence
  Description of Artificial Sequence: Synthetic polynucleotide
  gnl|Fabrus|VH3-49_IGHD3-22*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattactatgatagtagtggttattactacgactactttgactactggggccaaggaaccctggtcaccgtctcctcagctagc

SEQ ID NO: 929 - DNA, 410 bp, Artificial Sequence
  Description of Artificial Sequence: Synthetic polynucleotide
  gnl|Fabrus|VH3-49_IGHD3-9*01_IGHJ6*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagagtattacgatattttgactggttattataacgattactactactactacggtatggacgtctgggggcaagggaccacggtcaccgtctcctcagctagc

SEQ ID NO: 930 - DNA, 383 bp, Artificial Sequence
  Description of Artificial Sequence: Synthetic polynucleotide
  gnl|Fabrus|VH3-49_IGHD5-18*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggtggatacagctatggttacgactactttgactactggggccaaggaaccctggtcaccgtctcctcagctagc

SEQ ID NO: 931 - DNA, 386 bp, Artificial Sequence
  Description of Artificial Sequence: Synthetic polynucleotide
  gnl|Fabrus|VH3-49_IGHD6-13*01_IGHJ4*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggggtatagcagcagctggtacgactactttgactactggggccaaggaaccctggtcaccgtctcctcagctagc

SEQ ID NO: 932 - DNA, 377 bp, Artificial Sequence
  Description of Artificial Sequence: Synthetic polynucleotide
  gnl|Fabrus|VH3-49_IGHD7-27*01_IGHJ1*01
ccatggcagaggtgcagctggtggagtctgggggaggcttggtacagccagggcggtccctgagactctcctgtaccgcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagctaactggggagctgaatacttccagcactggggccagggcaccctggtcaccgtctcctcagctagc

SEQ ID NO: 933 - DNA, 386 bp, Artificial Sequence
  Description of Artificial Sequence: Synthetic polynucleotide
  gnl|Fabrus|VH3-53_IGHD1-14*01_IGHJ6*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataaccggaaccacgattactactactactacggtatggacgtctgggggcaagggaccacggtcaccgtctcctcagctagc

SEQ ID NO: 934 - DNA, 374 bp, Artificial Sequence
  Description of Artificial Sequence: Synthetic polynucleotide
  gnl|Fabrus|VH3-53_IGHD1-7*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagggtataactggaactacgctgaatacttccagcactggggccagggcaccctggtcaccgtctcctcagctagc

SEQ ID NO: 935 - DNA, 389 bp, Artificial Sequence
  Description of Artificial Sequence: Synthetic polynucleotide
  gnl|Fabrus|VH3-53_IGHD2-2*01_IGHJ2*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaaggatattgtagtagtaccagctgctatgcctactggtacttcgatctctggggccgtggcaccctggtcactgtctcctcagctagc

SEQ ID NO: 936 - DNA, 386 bp, Artificial Sequence
  Description of Artificial Sequence: Synthetic polynucleotide
  gnl|Fabrus|VH3-53_IGHD3-22*01_IGHJ3*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagagtattactatgatagtagtggttattactacgatgcttttgatgtctggggccaagggacaatggtcaccgtctcttcagctagc

SEQ ID NO: 937 - DNA, 377 bp, Artificial Sequence
  Description of Artificial Sequence: Synthetic polynucleotide
  gnl|Fabrus|VH3-53_IGHD4-23*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatgactacggtggtaactccgctgaatacttccagcactggggccagggcaccctggtcaccgtctcctcagctagc

SEQ ID NO: 938 - DNA, 374 bp, Artificial Sequence
  Description of Artificial Sequence: Synthetic polynucleotide
  gnl|Fabrus|VH3-53_IGHD5-5*01_IGHJ4*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaggtggatacagctatggttacgactactttgactactggggccaaggaaccctggtcaccgtctcctcagctagc

SEQ ID NO: 939 - DNA, 377 bp, Artificial Sequence
  Description of Artificial Sequence: Synthetic polynucleotide
  gnl|Fabrus|VH3-53_IGHD6-13*01_IGHJ3*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagaggggtatagcagcagctggtacgatgcttttgatgtctggggccaagggacaatggtcaccgtctcttcagctagc

SEQ ID NO: 940 - DNA, 365 bp, Artificial Sequence
  Description of Artificial Sequence: Synthetic polynucleotide
  gnl|Fabrus|VH3-53_IGHD7-27*01_IGHJ4*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagctaactggggagactactttgactactggggccaaggaaccctggtcaccgtctcctcagctagc

SEQ ID NO: 941 - DNA, 377 bp, Artificial Sequence
  Description of Artificial Sequence: Synthetic polynucleotide
  gnl|Fabrus|VH3-64_IGHD1-26*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtatagtgggagctactacgactactttgactactggggccaaggaaccctggtcaccgtctcctcagctagc

SEQ ID NO: 942 - DNA, 389 bp, Artificial Sequence
  Description of Artificial Sequence: Synthetic polynucleotide
  gnl|Fabrus|VH3-64_IGHD1-7*01_IGHJ6*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagggtataactggaactacgattactactactactacggtatggacgtctgggggcaagggaccacggtcaccgtctcctcagctagc

SEQ ID NO: 943 - DNA, 392 bp, Artificial Sequence
  Description of Artificial Sequence: Synthetic polynucleotide
  gnl|Fabrus|VH3-64_IGHD2-2*01_IGHJ5*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaaggatattgtagtagtaccagctgctatgccgacaactggttcgactcctggggccaaggaaccctggtcaccgtctcctcagctagc

SEQ ID NO: 944 - DNA, 389 bp, Artificial Sequence
  Description of Artificial Sequence: Synthetic polynucleotide
  gnl|Fabrus|VH3-64_IGHD3-3*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagagtattacgatttttggagtggttattataccgactactttgactactggggccaaggaaccctggtcaccgtctcctcagctagc

SEQ ID NO: 945 - DNA, 374 bp, Artificial Sequence
  Description of Artificial Sequence: Synthetic polynucleotide
  gnl|Fabrus|VH3-64_IGHD4-17*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagatgactacggtgactacgactactttgactactggggccaaggaaccctggtcaccgtctcctcagctagc

SEQ ID NO: 946 - DNA, 380 bp, Artificial Sequence
  Description of Artificial Sequence: Synthetic polynucleotide
  gnl|Fabrus|VH3-64_IGHD5-12*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagaggtggatatagtggctacgattacgactactttgactactggggccaaggaaccctggtcaccgtctcctcagctagc

SEQ ID NO: 947 - DNA, 383 bp, Artificial Sequence
  Description of Artificial Sequence: Synthetic polynucleotide
  gnl|Fabrus|VH3-64_IGHD6-19*01_IGHJ1*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagaggggtatagcagtggctggtacgctgaatacttccagcactggggccagggcaccctggtcaccgtctcctcagctagc

SEQ ID NO: 948 - DNA, 368 bp, Artificial Sequence
  Description of Artificial Sequence: Synthetic polynucleotide
  gnl|Fabrus|VH3-64_IGHD7-27*01_IGHJ4*01
ccatggcagaggtgcagctggtggagtctggggaaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcagactctgtgaagggcagattcaccatctccagagacaattccaagaacacgctgtatcttcaaatgggcagcctgagagctgaggacatggctgtgtattactgtgcgagagctaactggggagactactttgactactggggccaaggaaccctggtcaccgtctcctcagctagc

SEQ ID NO: 949 - DNA, 377 bp, Artificial Sequence
  Description of Artificial Sequence: Synthetic polynucleotide
  gnl|Fabrus|VH3-66_IGHD6-6*01_IGHJ1*01
ccatggcagaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagctgtggtagcacatactacgcagactccgtgaagggccgattcaccatctccagagacaattccaagaacacgctgtatcttcaaatgaacagcctgagagctgaggacacggctgtgtattactgtgcgagagaggagtatagcagctcgtccgctgaatacttccagcactggggccagggcaccctggtcaccgtctcctcagctagc

SEQ ID NO: 950 - DNA, 374 bp, Artificial Sequence
  Description of Artificial Sequence: Synthetic polynucleotide
  gnl|Fabrus|VH3-7_IGHD1-20*01_IGHJ3*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaacgacgatgcttttgatgtctggggccaagggacaatggtcaccgtctcttcagctagc

SEQ ID NO: 951 - DNA, 389 bp, Artificial Sequence
  Description of Artificial Sequence: Synthetic polynucleotide
  gnl|Fabrus|VH3-7_IGHD1-7*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagggtataactggaactacgattactactactactacggtatggacgtctgggggcaagggaccacggtcaccgtctcctcagctagc

SEQ ID NO: 952 - DNA, 389 bp, Artificial Sequence
  Description of Artificial Sequence: Synthetic polynucleotide
  gnl|Fabrus|VH3-7_IGHD2-21*01_IGHJ5*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaagcatattgtggtggtgattgctattccgacaactggttcgactcctggggccaaggaaccctggtcaccgtctcctcagctagc

SEQ ID NO: 953 - DNA, 401 bp, Artificial Sequence
  Description of Artificial Sequence: Synthetic polynucleotide
  gnl|Fabrus|VH3-7_IGHD2-8*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggatattgtactaatggtgtatgctatacattactactactactacggtatggacgtctgggggcaagggaccacggtcaccgtctcctcagctagc

SEQ ID NO: 954 - DNA, 389 bp, Artificial Sequence
  Description of Artificial Sequence: Synthetic polynucleotide
  gnl|Fabrus|VH3-7_IGHD3-22*01_IGHJ3*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattactatgatagtagtggttattactacgatgcttttgatgtctggggccaagggacaatggtcaccgtctcttcagctagc

SEQ ID NO: 955 - DNA, 404 bp, Artificial Sequence
  Description of Artificial Sequence: Synthetic polynucleotide
  gnl|Fabrus|VH3-7_IGHD3-9*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagagtattacgatattttgactggttattataacgattactactactactacggtatggacgtctgggggcaagggaccacggtcaccgtctcctcagctagc

SEQ ID NO: 956 - DNA, 374 bp, Artificial Sequence
  Description of Artificial Sequence: Synthetic polynucleotide
  gnl|Fabrus|VH3-7_IGHD4-17*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatgactacggtgactacgactactttgactactggggccaaggaaccctggtcaccgtctcctcagctagc

SEQ ID NO: 957 - DNA, 380 bp, Artificial Sequence
  Description of Artificial Sequence: Synthetic polynucleotide
  gnl|Fabrus|VH3-7_IGHD5-12*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaggtggatatagtggctacgattacgactactttgactactggggccaaggaaccctggtcaccgtctcctcagctagc

SEQ ID NO: 958 - DNA, 377 bp, Artificial Sequence
  Description of Artificial Sequence: Synthetic polynucleotide
  gnl|Fabrus|VH3-7_IGHD5-24*01_IGHJ4*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggtagagatggctacaattaactactttgactactggggccaaggaaccctggtcaccgtctcctcagctagc

SEQ ID NO: 959 - DNA, 395 bp, Artificial Sequence
  Description of Artificial Sequence: Synthetic polynucleotide
  gnl|Fabrus|VH3-7_IGHD6-19*01_IGHJ6*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggggtatagcagtggctggtacgattactactactactacggtatggacgtctgggggcaagggaccacggtcaccgtctcctcagctagc

SEQ ID NO: 960 - DNA, 380 bp, Artificial Sequence
  Description of Artificial Sequence: Synthetic polynucleotide
  gnl|Fabrus|VH3-7_IGHD6-6*01_IGHJ1*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaggagtatagcagctcgtccgctgaatacttccagcactggggccagggcaccctggtcaccgtctcctcagctagc

SEQ ID NO: 961 - DNA, 371 bp, Artificial Sequence
  Description of Artificial Sequence: Synthetic polynucleotide
  gnl|Fabrus|VH3-7_IGHD7-27*01_IGHJ2*01
ccatggcagaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagctaactggggatactggtacttcgatctctggggccgtggcaccctggtcactgtctcctcagctagc

SEQ ID NO: 962 - DNA, 380 bp, Artificial Sequence
  Description of Artificial Sequence: Synthetic polynucleotide
  gnl|Fabrus|VH3-72_IGHD1-1*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagggtacaactggaacgacgactactttgactactggggccaaggaaccctggtcaccgtctcctcagctagc

SEQ ID NO: 963 - DNA, 398 bp, Artificial Sequence
  Description of Artificial Sequence: Synthetic polynucleotide
  gnl|Fabrus|VH3-72_IGHD2-15*01_IGHJ1*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaaggatattgtagtggtggtagctgctactccgctgaatacttccagcactggggccagggcaccctggtcaccgtctcctcagctagc

SEQ ID NO: 964 - DNA, 395 bp, Artificial Sequence
  Description of Artificial Sequence: Synthetic polynucleotide
  gnl|Fabrus|VH3-72_IGHD3-22*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattactatgatagtagtggttattactacgactactttgactactggggccaaggaaccctggtcaccgtctcctcagctagc

SEQ ID NO: 965 - DNA, 410 bp, Artificial Sequence
  Description of Artificial Sequence: Synthetic polynucleotide
  gnl|Fabrus|VH3-72_IGHD3-9*01_IGHJ6*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagagtattacgatattttgactggttattataacgattactactactactacggtatggacgtctgggggcaagggaccacggtcaccgtctcctcagctagc

SEQ ID NO: 966 - DNA, 386 bp, Artificial Sequence
  Description of Artificial Sequence: Synthetic polynucleotide
  gnl|Fabrus|VH3-72_IGHD4-23*01_IGHJ2*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagatgactacggtggtaactcctactggtacttcgatctctggggccgtggcaccctggtcactgtctcctcagctagc

SEQ ID NO: 967 - DNA, 383 bp, Artificial Sequence
  Description of Artificial Sequence: Synthetic polynucleotide
  gnl|Fabrus|VH3-72_IGHD5-18*01_IGHJ4*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtggatacagctatggttacgactactttgactactggggccaaggaaccctggtcaccgtctcctcagctagc

SEQ ID NO: 968 - DNA, 398 bp, Artificial Sequence
  Description of Artificial Sequence: Synthetic polynucleotide
  gnl|Fabrus|VH3-72_IGHD5-24*01_IGHJ6*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagaggtagagatggctacaattacgattactactactactacggtatggacgtctgggggcaagggaccacggtcaccgtctcctcagctagc

SEQ ID NO: 969 - DNA, 386 bp, Artificial Sequence
  Description of Artificial Sequence: Synthetic polynucleotide
  gnl|Fabrus|VH3-72_IGHD6-6*01_IGHJ1*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagaggagtatagcagctcgtccgctgaatacttccagcactggggccagggcaccctggtcaccgtctcctcagctagc

SEQ ID NO: 970 - DNA, 377 bp, Artificial Sequence
  Description of Artificial Sequence: Synthetic polynucleotide
  gnl|Fabrus|VH3-72_IGHD7-27*01_IGHJ2*01
ccatggcagaggtgcagctggtggagtctgggggaggcttggtccagcctggagggtccctgagactctcctgtgcagcctctggattcaccttcagtgaccactacatggactgggtccgccaggctccagggaaggggctggagtgggttggccgtactagaaacaaagctaacagttacaccacagaatacgccgcgtctgtgaaaggcagattcaccatctcaagagatgattcaaagaactcactgtatctgcaaatgaacagcctgaaaaccgaggacacggccgtgtattactgtgctagagctaactggggatactggtacttcgatctctggggccgtggcaccctggtcactgtctcctcagctagc

SEQ ID NO: 971 - DNA, 383 bp, Artificial Sequence
  Description of Artificial Sequence: Synthetic polynucleotide
  gnl|Fabrus|VH3-73_IGHD1-1*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacggtacaactggaacgacgacaactggttcgactcctggggccaaggaaccctggtcaccgtctcctcagctagc

SEQ ID NO: 972 - DNA, 398 bp, Artificial Sequence
  Description of Artificial Sequence: Synthetic polynucleotide
  gnl|Fabrus|VH3-73_IGHD2-8*01_IGHJ2*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaaggatattgtactaatggtgtatgctatacctactggtacttcgatctctggggccgtggcaccctggtcactgtctcctcagctagc

SEQ ID NO: 973 - DNA, 395 bp, Artificial Sequence
  Description of Artificial Sequence: Synthetic polynucleotide
  gnl|Fabrus|VH3-73_IGHD3-22*01_IGHJ4*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattactatgatagtagtggttattactacgactactttgactactggggccaaggaaccctggtcaccgtctcctcagctagc

SEQ ID NO: 974 - DNA, 410 bp, Artificial Sequence
  Description of Artificial Sequence: Synthetic polynucleotide
  gnl|Fabrus|VH3-73_IGHD3-9*01_IGHJ6*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacagtattacgatattttgactggttattataacgattactactactactacggtatggacgtctgggggcaagggaccacggtcaccgtctcctcagctagc

SEQ ID NO: 975 - DNA, 395 bp, Artificial Sequence
  Description of Artificial Sequence: Synthetic polynucleotide
  gnl|Fabrus|VH3-73_IGHD4-11*01_IGHJ6*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacagtaactacgattactactactactacggtatggacgtctgggggcaagggaccacggtcaccgtctcctcagctagc

SEQ ID NO: 976 - DNA, 386 bp, Artificial Sequence
  Description of Artificial Sequence: Synthetic polynucleotide
  gnl|Fabrus|VH3-73_IGHD4-23*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacatgactacggtggtaactccgacaactggttcgactcctggggccaaggaaccctggtcaccgtctcctcagctagc

SEQ ID NO: 977 - DNA, 386 bp, Artificial Sequence
  Description of Artificial Sequence: Synthetic polynucleotide
  gnl|Fabrus|VH3-73_IGHD5-12*01_IGHJ4*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacgtggatatagtggctacgattacgactactttgactactggggccaaggaaccctggtcaccgtctcctcagctagc

SEQ ID NO: 978 - DNA, 389 bp, Artificial Sequence
  Description of Artificial Sequence: Synthetic polynucleotide
  gnl|Fabrus|VH3-73_IGHD6-19*01_IGHJ1*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacaggggtatagcagtggctggtacgctgaatacttccagcactggggccagggcaccctggtcaccgtctcctcagctagc

SEQ ID NO: 979 - DNA, 377 bp, Artificial Sequence
  Description of Artificial Sequence: Synthetic polynucleotide
  gnl|Fabrus|VH3-73_IGHD7-27*01_IGHJ5*01
ccatggcagaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacctaactggggagacaactggttcgactcctggggccaaggaaccctggtcaccgtctcctcagctagc

SEQ ID NO: 980 - DNA, 389 bp, Artificial Sequence
  Description of Artificial Sequence: Synthetic polynucleotide
  gnl|Fabrus|VH3-74_IGHD1-1*01_IGHJ6*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtacaactggaacgacgattactactactactacggtatggacgtctgggggcaagggaccacggtcaccgtctcctcagctagc

SEQ ID NO: 981 - DNA, 377 bp, Artificial Sequence
  Description of Artificial Sequence: Synthetic polynucleotide
  gnl|Fabrus|VH3-74_IGHD1-26*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagggtatagtgggagctactacgactactttgactactggggccaaggaaccctggtcaccgtctcctcagctagc

SEQ ID NO: 982 - DNA, 392 bp, Artificial Sequence
  Description of Artificial Sequence: Synthetic polynucleotide
  gnl|Fabrus|VH3-74_IGHD2-2*01_IGHJ5*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaaggatattgtagtagtaccagctgctatgccgacaactggttcgactcctggggccaaggaaccctggtcaccgtctcctcagctagc

SEQ ID NO: 983 - DNA, 392 bp, Artificial Sequence
  Description of Artificial Sequence: Synthetic polynucleotide
  gnl|Fabrus|VH3-74_IGHD3-22*01_IGHJ5*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagtattactatgatagtagtggttattactacgacaactggttcgactcctggggccaaggaaccctggtcaccgtctcctcagctagc

SEQ ID NO: 984 - DNA, 377 bp, Artificial Sequence
  Description of Artificial Sequence: Synthetic polynucleotide
  gnl|Fabrus|VH3-74_IGHD4-17*01_IGHJ1*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatgactacggtgactacgctgaatacttccagcactggggccagggcaccctggtcaccgtctcctcagctagc

SEQ ID NO: 985 - DNA, 380 bp, Artificial Sequence
  Description of Artificial Sequence: Synthetic polynucleotide
  gnl|Fabrus|VH3-74_IGHD5-12*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagaggtggatatagtggctacgattacgactactttgactactggggccaaggaaccctggtcaccgtctcctcagctagc

SEQ ID NO: 986 - DNA, 380 bp, Artificial Sequence
  Description of Artificial Sequence: Synthetic polynucleotide
  gnl|Fabrus|VH3-74_IGHD6-6*01_IGHJ1*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagaggagtatagcagctcgtccgctgaatacttccagcactggggccagggcaccctggtcaccgtctcctcagctagc

SEQ ID NO: 987 - DNA, 368 bp, Artificial Sequence
  Description of Artificial Sequence: Synthetic polynucleotide
  gnl|Fabrus|VH3-74_IGHD7-27*01_IGHJ4*01
ccatggcagaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagctaactggggagactactttgactactggggccaaggaaccctggtcaccgtctcctcagctagc

SEQ ID NO: 988 - DNA, 392 bp, Artificial Sequence
  Description of Artificial Sequence: Synthetic polynucleotide
  gnl|Fabrus|VH3-9_IGHD1-1*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtacaactggaacgacgattactactactactacggtatggacgtctgggggcaagggaccacggtcaccgtctcctcagctagc

SEQ ID NO: 989 - DNA, 380 bp, Artificial Sequence
  Description of Artificial Sequence: Synthetic polynucleotide
  gnl|Fabrus|VH3-9_IGHD1-7*01_IGHJ5*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtataactggaactacgacaactggttcgactcctggggccaaggaaccctggtcaccgtctcctcagctagc

SEQ ID NO: 990 - DNA, 392 bp, Artificial Sequence
  Description of Artificial Sequence: Synthetic polynucleotide
  gnl|Fabrus|VH3-9_IGHD2-2*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagaggatattgtagtagtaccagctgctatgccgactactttgactactggggccaaggaaccctggtcaccgtctcctcagctagc

SEQ ID NO: 991 - DNA, 413 bp, Artificial Sequence
  Description of Artificial Sequence: Synthetic polynucleotide
  gnl|Fabrus|VH3-9_IGHD3-16*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattatgattacgtttgggggagttatgcttataccgattactactactactacggtatggacgtctgggggcaagggaccacggtcaccgtctcctcagctagc

SEQ ID NO: 992 - DNA, 392 bp, Artificial Sequence
  Description of Artificial Sequence: Synthetic polynucleotide
  gnl|Fabrus|VH3-9_IGHD3-22*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagataggtattactatgatagtagtggttattactacgactactttgactactggggccaaggaaccctggtcaccgtctcctcagctagc

SEQ ID NO: 993 - DNA, 377 bp, Artificial Sequence
  Description of Artificial Sequence: Synthetic polynucleotide
  gnl|Fabrus|VH3-9_IGHD4-11*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtgactacagtaactacgactactttgactactggggccaaggaaccctggtcaccgtctcctcagctagc

SEQ ID NO: 994 - DNA, 383 bp, Artificial Sequence
  Description of Artificial Sequence: Synthetic polynucleotide
  gnl|Fabrus|VH3-9_IGHD5-24*01_IGHJ1*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatagtagagatggctacaattacgctgaatacttccagcactggggccagggcaccctggtcaccgtctcctcagctagc

SEQ ID NO: 995 - DNA, 380 bp, Artificial Sequence
  Description of Artificial Sequence: Synthetic polynucleotide
  gnl|Fabrus|VH3-9_IGHD6-13*01_IGHJ4*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcagctggtacgactactttgactactggggccaaggaaccctggtcaccgtctcctcagctagc

SEQ ID NO: 996 - DNA, 392 bp, Artificial Sequence
  Description of Artificial Sequence: Synthetic polynucleotide
  gnl|Fabrus|VH3-9_IGHD6-25*01_IGHJ6*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatgggtatagcagcggctacgattactactactactacggtatggacgtctgggggcaagggaccacggtcaccgtctcctcagctagc

SEQ ID NO: 997 - DNA, 374 bp, Artificial Sequence
  Description of Artificial Sequence: Synthetic polynucleotide
  gnl|Fabrus|VH3-9_IGHD7-27*01_IGHJ2*01
ccatggcagaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatactaactggggatactggtacttcgatctctggggccgtggcaccctggtcactgtctcctcagctagc

SEQ ID NO: 998 - DNA, 377 bp, Artificial Sequence
  Description of Artificial Sequence: Synthetic polynucleotide
  gnl|Fabrus|VH4-28_IGHD1-20*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaacgacgctgaatacttccagcactggggccagggcaccctggtcaccgtctcctcagctagc

SEQ ID NO: 999 - DNA, 389 bp, Artificial Sequence
  Description of Artificial Sequence: Synthetic polynucleotide
  gnl|Fabrus|VH4-28_IGHD1-7*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaggtataactggaactacgattactactactactacggtatggacgtctgggggcaagggaccacggtcaccgtctcctcagctagc

SEQ ID NO: 1000 - DNA, 404 bp, Artificial Sequence
  Description of Artificial Sequence: Synthetic polynucleotide
  gnl|Fabrus|VH4-28_IGHD2-15*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaaggatattgtagtggtggtagctgctactccgattactactactactacggtatggacgtctgggggcaagggaccacggtcaccgtctcctcagctagc

SEQ ID NO: 1001 - DNA, 398 bp, Artificial Sequence
  Description of Artificial Sequence: Synthetic polynucleotide
  gnl|Fabrus|VH4-28_IGHD3-16*01_IGHJ2*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattatgattacgtttgggggagttatgcttatacctactggtacttcgatctctggggccgtggcaccctggtcactgtctcctcagctagc

SEQ ID NO: 1002 - DNA, 404 bp, Artificial Sequence
  Description of Artificial Sequence: Synthetic polynucleotide
  gnl|Fabrus|VH4-28_IGHD3-9*01_IGHJ6*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaagtattacgatattttgactggttattataacgattactactactactacggtatggacgtctgggggcaagggaccacggtcaccgtctcctcagctagc

SEQ ID NO: 1003 - DNA, 374 bp, Artificial Sequence
  Description of Artificial Sequence: Synthetic polynucleotide
  gnl|Fabrus|VH4-28_IGHD4-4*01_IGHJ4*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaatgactacagtaactacgactactttgactactggggccaaggaaccctggtcaccgtctcctcagctagc

SEQ ID NO: 1004 - DNA, 380 bp, Artificial Sequence
  Description of Artificial Sequence: Synthetic polynucleotide
  gnl|Fabrus|VH4-28_IGHD5-5*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaagtggatacagctatggttacgctgaatacttccagcactggggccagggcaccctggtcaccgtctcctcagctagc

SEQ ID NO: 1005 - DNA, 380 bp, Artificial Sequence
  Description of Artificial Sequence: Synthetic polynucleotide
  gnl|Fabrus|VH4-28_IGHD6-13*01_IGHJ4*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaaaggggtatagcagcagctggtacgactactttgactactggggccaaggaaccctggtcaccgtctcctcagctagc

SEQ ID NO: 1006 - DNA, 371 bp, Artificial Sequence
  Description of Artificial Sequence: Synthetic polynucleotide
  gnl|Fabrus|VH4-28_IGHD7-27*01_IGHJ1*01
ccatggcacaggtgcagctgcaggagtcgggcccaggactggtgaagccttcggacaccctgtccctcacctgcgctgtctctggttactccatcagcagtagtaactggtggggctggattcggcagcccccagggaagggactggagtggattgggtacatctattatagtgggagcacctactacaacccgtccctcaagagtcgagtcaccatgtcagtagacacgtccaagaaccagttctccctgaagctgagctctgtgaccgccgtggacacggccgtgtattactgtgcgagaactaactggggagctgaatacttccagcactggggccagggcaccctggtcaccgtctcctcagctagc

SEQ ID NO: 1007 - DNA, 383 bp, Artificial Sequence
  Description of Artificial Sequence: Synthetic polynucleotide
  gnl|Fabrus|VH4-31_IGHD1-26*01_IGHJ2*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagggtatagtgggagctactactactggtacttcgatctctggggccgtggcaccctggtcactgtctcctcagctagc

SEQ ID NO: 1008 - DNA, 395 bp, Artificial Sequence
  Description of Artificial Sequence: Synthetic polynucleotide
  gnl|Fabrus|VH4-31_IGHD2-15*01_IGHJ2*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtggtggtagctgctactcctactggtacttcgatctctggggccgtggcaccctggtcactgtctcctcagctagc

SEQ ID NO: 1009 - DNA, 407 bp, Artificial Sequence
  Description of Artificial Sequence: Synthetic polynucleotide
  gnl|Fabrus|VH4-31_IGHD2-2*01_IGHJ6*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaaggatattgtagtagtaccagctgctatgccgattactactactactacggtatggacgtctgggggcaagggaccacggtcaccgtctcctcagctagc

SEQ ID NO: 1010 - DNA, 392 bp, Artificial Sequence
  Description of Artificial Sequence: Synthetic polynucleotide
  gnl|Fabrus|VH4-31_IGHD3-10*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattactatggttcggggagttattataacgactactttgactactggggccaaggaaccctggtcaccgtctcctcagctagc

SEQ ID NO: 1011 - DNA, 407 bp, Artificial Sequence
  Description of Artificial Sequence: Synthetic polynucleotide
  gnl|Fabrus|VH4-31_IGHD3-9*01_IGHJ6*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagtattacgatattttgactggttattataacgattactactactactacggtatggacgtctgggggcaagggaccacggtcaccgtctcctcagctagc

SEQ ID NO: 1012 - DNA, 380 bp, Artificial Sequence
  Description of Artificial Sequence: Synthetic polynucleotide
  gnl|Fabrus|VH4-31_IGHD4-17*01_IGHJ5*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagatgactacggtgactacgacaactggttcgactcctggggccaaggaaccctggtcaccgtctcctcagctagc

SEQ ID NO: 1013 - DNA, 383 bp, Artificial Sequence
  Description of Artificial Sequence: Synthetic polynucleotide
  gnl|Fabrus|VH4-31_IGHD5-12*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaggtggatatagtggctacgattacgactactttgactactggggccaaggaaccctggtcaccgtctcctcagctagc

SEQ ID NO: 1014 - DNA, 383 bp, Artificial Sequence
  Description of Artificial Sequence: Synthetic polynucleotide
  gnl|Fabrus|VH4-31_IGHD6-13*01_IGHJ4*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggggtatagcagcagctggtacgactactttgactactggggccaaggaaccctggtcaccgtctcctcagctagc

SEQ ID NO: 1015 - DNA, 383 bp, Artificial Sequence
  Description of Artificial Sequence: Synthetic polynucleotide
  gnl|Fabrus|VH4-31_IGHD6-6*01_IGHJ1*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggagtatagcagctcgtccgctgaatacttccagcactggggccagggcaccctggtcaccgtctcctcagctagc

SEQ ID NO: 1016 - DNA, 374 bp, Artificial Sequence
  Description of Artificial Sequence: Synthetic polynucleotide
  gnl|Fabrus|VH4-31_IGHD7-27*01_IGHJ5*01
ccatggcacaggtgcagctgcaggagtcgggcccaggactggtgaagccttcacagaccctgtccctcacctgtactgtctctggtggctccatcagcagtggtggttactactggagctggattcgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagctaactggggagacaactggttcgactcctggggccaaggaaccctggtcaccgtctcctcagctagc

SEQ ID NO: 1017 - DNA, 371 bp, Artificial Sequence
  Description of Artificial Sequence: Synthetic polynucleotide
  gnl|Fabrus|VH4-34_IGHD1-7*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtataactggaactacgactactttgactactggggccaaggaaccctggtcaccgtctcctcagctagc

SEQ ID NO: 1018 - DNA, 386 bp, Artificial Sequence
  Description of Artificial Sequence: Synthetic polynucleotide
  gnl|Fabrus|VH4-34_IGHD2-2*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggaggatattgtagtagtaccagctgctatgccgactactttgactactggggccaaggaaccctggtcaccgtctcctcagctagc

SEQ ID NO: 1019 - DNA, 392 bp, Artificial Sequence
  Description of Artificial Sequence: Synthetic polynucleotide
  gnl|Fabrus|VH4-34_IGHD3-16*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattatgattacgtttgggggagttatgcttataccgactactttgactactggggccaaggaaccctggtcaccgtctcctcagctagc

SEQ ID NO: 1020 - DNA, 401 bp, Artificial Sequence
  Description of Artificial Sequence: Synthetic polynucleotide
  gnl|Fabrus|VH4-34_IGHD3-22*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagggtattactatgatagtagtggttattactacgattactactactactacggtatggacgtctgggggcaagggaccacggtcaccgtctcctcagctagc

SEQ ID NO: 1021 - DNA, 371 bp, Artificial Sequence
  Description of Artificial Sequence: Synthetic polynucleotide
  gnl|Fabrus|VH4-34_IGHD4-17*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtgactacggtgactacgactactttgactactggggccaaggaaccctggtcaccgtctcctcagctagc

SEQ ID NO: 1022 - DNA, 377 bp, Artificial Sequence
  Description of Artificial Sequence: Synthetic polynucleotide
  gnl|Fabrus|VH4-34_IGHD5-12*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggtggatatagtggctacgattacgactactttgactactggggccaaggaaccctggtcaccgtctcctcagctagc

SEQ ID NO: 1023 - DNA, 377 bp, Artificial Sequence
  Description of Artificial Sequence: Synthetic polynucleotide
  gnl|Fabrus|VH4-34_IGHD6-13*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcagctggtacgactactttgactactggggccaaggaaccctggtcaccgtctcctcagctagc

SEQ ID NO: 1024 - DNA, 389 bp, Artificial Sequence
  Description of Artificial Sequence: Synthetic polynucleotide
  gnl|Fabrus|VH4-34_IGHD6-25*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggggtatagcagcggctacgattactactactactacggtatggacgtctgggggcaagggaccacggtcaccgtctcctcagctagc

SEQ ID NO: 1025 - DNA, 389 bp, Artificial Sequence
  Description of Artificial Sequence: Synthetic polynucleotide
  gnl|Fabrus|VH4-34_IGHD6-6*01_IGHJ6*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggggagtatagcagctcgtccgattactactactactacggtatggacgtctgggggcaagggaccacggtcaccgtctcctcagctagc

SEQ ID NO: 1026 - DNA, 365 bp, Artificial Sequence
  Description of Artificial Sequence: Synthetic polynucleotide
  gnl|Fabrus|VH4-34_IGHD7-27*01_IGHJ4*01
ccatggcacaggtgcagctacagcagtggggcgcaggactgttgaagccttcggagaccctgtccctcacctgcgctgtctatggtgggtccttcagtggttactactggagctggattcgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagctaactggggagactactttgactactggggccaaggaaccctggtcaccgtctcctcagctagc

SEQ ID NO: 1027 - DNA, 380 bp, Artificial Sequence
  Description of Artificial Sequence: Synthetic polynucleotide
  gnl|Fabrus|VH4-39_IGHD1-14*01_IGHJ1*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataaccggaaccacgctgaatacttccagcactggggccagggcaccctggtcaccgtctcctcagctagc

SEQ ID NO: 1028 - DNA, 392 bp, Artificial Sequence
  Description of Artificial Sequence: Synthetic polynucleotide
  gnl|Fabrus|VH4-39_IGHD1-20*01_IGHJ6*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacggtataactggaacgacgattactactactactacggtatggacgtctgggggcaagggaccacggtcaccgtctcctcagctagc

SEQ ID NO: 1029 - DNA, 389 bp, Artificial Sequence
  Description of Artificial Sequence: Synthetic polynucleotide
  gnl|Fabrus|VH4-39_IGHD2-21*01_IGHJ3*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaagcatattgtggtggtgattgctattccgatgcttttgatgtctggggccaagggacaatggtcaccgtctcttcagctagc

SEQ ID NO: 1030 - DNA, 392 bp, Artificial Sequence
  Description of Artificial Sequence: Synthetic polynucleotide
  gnl|Fabrus|VH4-39_IGHD3-10*01_IGHJ4*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattactatggttcggggagttattataacgactactttgactactggggccaaggaaccctggtcaccgtctcctcagctagc

SEQ ID NO: 1031 - DNA, 401 bp, Artificial Sequence
  Description of Artificial Sequence: Synthetic polynucleotide
  gnl|Fabrus|VH4-39_IGHD3-16*01_IGHJ2*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattatgattacgtttgggggagttatgcttatacctactggtacttcgatctctggggccgtggcaccctggtcactgtctcctcagctagc

SEQ ID NO: 1032 - DNA, 407 bp, Artificial Sequence
  Description of Artificial Sequence: Synthetic polynucleotide
  gnl|Fabrus|VH4-39_IGHD3-9*01_IGHJ6*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacagtattacgatattttgactggttattataacgattactactactactacggtatggacgtctgggggcaagggaccacggtcaccgtctcctcagctagc

SEQ ID NO: 1033 - DNA, 383 bp, Artificial Sequence
  Description of Artificial Sequence: Synthetic polynucleotide
  gnl|Fabrus|VH4-39_IGHD4-23*01_IGHJ2*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacatgactacggtggtaactcctactggtacttcgatctctggggccgtggcaccctggtcactgtctcctcagctagc

SEQ ID NO: 1034 - DNA, 383 bp, Artificial Sequence
  Description of Artificial Sequence: Synthetic polynucleotide
  gnl|Fabrus|VH4-39_IGHD5-12*01_IGHJ4*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacgtggatatagtggctacgattacgactactttgactactggggccaaggaaccctggtcaccgtctcctcagctagc

SEQ ID NO: 1035 - DNA, 383 bp, Artificial Sequence
  Description of Artificial Sequence: Synthetic polynucleotide
  gnl|Fabrus|VH4-39_IGHD6-6*01_IGHJ1*01
ccatggcacagctgcagctgcaggagtcgggcccaggactggtgaagccttcggagaccctgtccctcacctgcactgtctctggtggctccatcagcagtagtagttactactggggctggattcgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacaggagtatagcagctcgtccgctgaatacttccagcactggggccagggcaccctggtcaccgtctcctcagctagc

SEQ ID NO: 1036 - DNA, 371 bp, Artificial Sequence
  Description of Artificial Sequence: Synthetic polynucleotide
  gnl|Fabrus|VH4-4_IGHD1-20*01_IGHJ3*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagggtataactggaacgacgatgcttttgatgtctggggccaagggacaatggtcaccgtctcttcagctagc

SEQ ID NO: 1037 - DNA, 386 bp, Artificial Sequence
  Description of Artificial Sequence: Synthetic polynucleotide
  gnl|Fabrus|VH4-4_IGHD2-8*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaaggatattgtactaatggtgtatgctataccgactactttgactactggggccaaggaaccctggtcaccgtctcctcagctagc

SEQ ID NO: 1038 - DNA, 389 bp, Artificial Sequence
  Description of Artificial Sequence: Synthetic polynucleotide
  gnl|Fabrus|VH4-4_IGHD3-22*01_IGHJ2*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagagtattactatgatagtagtggttattactactactggtacttcgatctctggggccgtggcaccctggtcactgtctcctcagctagc

SEQ ID NO: 1039 - DNA, 374 bp, Artificial Sequence
  Description of Artificial Sequence: Synthetic polynucleotide
  gnl|Fabrus|VH4-4_IGHD4-23*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagatgactacggtggtaactccgactactttgactactggggccaaggaaccctggtcaccgtctcctcagctagc

SEQ ID NO: 1040 - DNA, 380 bp, Artificial Sequence
  Description of Artificial Sequence: Synthetic polynucleotide
  gnl|Fabrus|VH4-4_IGHD5-12*01_IGHJ5*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagaggtggatatagtggctacgattacgacaactggttcgactcctggggccaaggaaccctggtcaccgtctcctcagctagc

SEQ ID NO: 1041 - DNA, 374 bp, Artificial Sequence
  Description of Artificial Sequence: Synthetic polynucleotide
  gnl|Fabrus|VH4-4_IGHD6-6*01_IGHJ4*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagaggagtatagcagctcgtccgactactttgactactggggccaaggaaccctggtcaccgtctcctcagctagc

SEQ ID NO: 1042 - DNA, 380 bp, Artificial Sequence
  Description of Artificial Sequence: Synthetic polynucleotide
  gnl|Fabrus|VH4-4_IGHD7-27*01_IGHJ6*01
ccatggcacaggtgcagctgcaggagtcgggcccaggactggtgaagccttcggagaccctgtccctcacctgcactgtctctggtggctccatcagtagttactactggagctggattcggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcgagagctaactggggagattactactactactacggtatggacgtctgggggcaagggaccacggtcaccgtctcctcagctagc

SEQ ID NO: 1043 - DNA, 374 bp, Artificial Sequence
  Description of Artificial Sequence: Synthetic polynucleotide
  gnl|Fabrus|VH4-59_IGHD6-25*01_IGHJ3*01
ccatggcacaggtgcagctgcaggagtcgggcccaggactggtgaagccttcggagaccctgtccctcacctgcactgtctctggtggctccatcagtagttactactggagctggattcggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagaggggtatagcagcggctacgatgcttttgatgtctggggccaagggacaatggtcaccgtctcttcagctagc

SEQ ID NO: 1044 - DNA, 374 bp, Artificial Sequence
  Description of Artificial Sequence: Synthetic polynucleotide
  gnl|Fabrus|VH5-51_IGHD1-14*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtataaccggaaccacgactactttgactactggggccaaggaaccctggtcaccgtctcctcagctagc

SEQ ID NO: 1045 - DNA, 392 bp, Artificial Sequence
  Description of Artificial Sequence: Synthetic polynucleotide
  gnl|Fabrus|VH5-51_IGHD1-26*01_IGHJ6*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacggtatagtgggagctactacgattactactactactacggtatggacgtctgggggcaagggaccacggtcaccgtctcctcagctagc

SEQ ID NO: 1046 - DNA, 389 bp, Artificial Sequence
  Description of Artificial Sequence: Synthetic polynucleotide
  gnl|Fabrus|VH5-51_IGHD2-8*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaaggatattgtactaatggtgtatgctataccgactactttgactactggggccaaggaaccctggtcaccgtctcctcagctagc

SEQ ID NO: 1047 - DNA, 404 bp, Artificial Sequence
  Description of Artificial Sequence: Synthetic polynucleotide
  gnl|Fabrus|VH5-51_IGHD3-10*01_IGHJ6*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattactatggttcggggagttattataacgattactactactactacggtatggacgtctgggggcaagggaccacggtcaccgtctcctcagctagc

SEQ ID NO: 1048 - DNA, 389 bp, Artificial Sequence
  Description of Artificial Sequence: Synthetic polynucleotide
  gnl|Fabrus|VH5-51_IGHD3-3*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagtattacgatttttggagtggttattataccgactactttgactactggggccaaggaaccctggtcaccgtctcctcagctagc

SEQ ID NO: 1049 - DNA, 374 bp, Artificial Sequence
  Description of Artificial Sequence: Synthetic polynucleotide
  gnl|Fabrus|VH5-51_IGHD4-17*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatgactacggtgactacgactactttgactactggggccaaggaaccctggtcaccgtctcctcagctagc

SEQ ID NO: 1050 - DNA, 377 bp, Artificial Sequence
  Description of Artificial Sequence: Synthetic polynucleotide
  gnl|Fabrus|VH5-51_IGHD5-18*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgtggatacagctatggttacgactactttgactactggggccaaggaaccctggtcaccgtctcctcagctagc

SEQ ID NO: 1051 - DNA, 377 bp, Artificial Sequence
  Description of Artificial Sequence: Synthetic polynucleotide
  gnl|Fabrus|VH5-51_IGHD5-18*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggtggatacagctatggttaactactttgactactggggccaaggaaccctggtcaccgtctcctcagctagc

SEQ ID NO: 1052 - DNA, 377 bp, Artificial Sequence
  Description of Artificial Sequence: Synthetic polynucleotide
  gnl|Fabrus|VH5-51_IGHD6-25*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacaggggtatagcagcggctacgactactttgactactggggccaaggaaccctggtcaccgtctcctcagctagc

SEQ ID NO: 1053 - DNA, 368 bp, Artificial Sequence
  Description of Artificial Sequence: Synthetic polynucleotide
  gnl|Fabrus|VH5-51_IGHD7-27*01_IGHJ4*01
ccatggcagaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacagctaactggggactactttgactactggggccaaggaaccctggtcaccgtctcctcagctagc

SEQ ID NO: 1054 - DNA, 383 bp, Artificial Sequence
  Description of Artificial Sequence: Synthetic polynucleotide
  gnl|Fabrus|VH6-1_IGHD1-1*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtacaactggaacgacgactactttgactactggggccaaggaaccctggtcaccgtctcctcagctagc

SEQ ID NO: 1055 - DNA, 398 bp, Artificial Sequence
  Description of Artificial Sequence: Synthetic polynucleotide
  gnl|Fabrus|VH6-1_IGHD1-20*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggtataactggaacgacgattactactactactacggtatggacgtctgggggcaagggaccacggtcaccgtctcctcagctagc

SEQ ID NO: 1056 - DNA, 398 bp, Artificial Sequence
  Description of Artificial Sequence: Synthetic polynucleotide
  gnl|Fabrus|VH6-1_IGHD2-15*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaaggatattgtagtggtggtagctgctactccgactactttgactactggggccaaggaaccctggtcaccgtctcctcagctagc

SEQ ID NO: 1057 - DNA, 410 bp, Artificial Sequence
  Description of Artificial Sequence: Synthetic polynucleotide
  gnl|Fabrus|VH6-1_IGHD2-21*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaagcatattgtggtggtgattgctattccgattactactactactacggtatggacgtctgggggcaagggaccacggtcaccgtctcctcagctagc

SEQ ID NO: 1058 - DNA, 407 bp, Artificial Sequence
  Description of Artificial Sequence: Synthetic polynucleotide
  gnl|Fabrus|VH6-1_IGHD3-16*01_IGHJ5*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattatgattacgtttgggggagttatgcttataccgacaactggttcgactcctggggccaaggaaccctggtcaccgtctcctcagctagc

SEQ ID NO: 1059 - DNA, 398 bp, Artificial Sequence
  Description of Artificial Sequence: Synthetic polynucleotide
  gnl|Fabrus|VH6-1_IGHD3-3*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagagtattacgatttttggagtggttattataccgactactttgactactggggccaaggaaccctggtcaccgtctcctcagctagc

SEQ ID NO: 1060 - DNA, 398 bp, Artificial Sequence
  Description of Artificial Sequence: Synthetic polynucleotide
  gnl|Fabrus|VH6-1_IGHD4-11*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacagtaactacgattactactactactacggtatggacgtctgggggcaagggaccacggtcaccgtctcctcagctagc

SEQ ID NO: 1061 - DNA, 386 bp, Artificial Sequence
  Description of Artificial Sequence: Synthetic polynucleotide
  gnl|Fabrus|VH6-1_IGHD4-23*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagatgactacggtggtaactccgactactttgactactggggccaaggaaccctggtcaccgtctcctcagctagc

SEQ ID NO: 1062 - DNA, 386 bp, Artificial Sequence
  Description of Artificial Sequence: Synthetic polynucleotide
  gnl|Fabrus|VH6-1_IGHD5-5*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagaggtggatacagctatggttacgactactttgactactggggccaaggaaccctggtcaccgtctcctcagctagc

SEQ ID NO: 1063 - DNA, 389 bp, Artificial Sequence
  Description of Artificial Sequence: Synthetic polynucleotide
  gnl|Fabrus|VH6-1_IGHD6-13*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcagctggtacgactactttgactactggggccaaggaaccctggtcaccgtctcctcagctagc

SEQ ID NO: 1064 - DNA, 401 bp, Artificial Sequence
  Description of Artificial Sequence: Synthetic polynucleotide
  gnl|Fabrus|VH6-1_IGHD6-25*01_IGHJ6*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggggtatagcagcggctacgattactactactactacggtatggacgtctgggggcaagggaccacggtcaccgtctcctcagctagc

SEQ ID NO: 1065 - DNA, 377 bp, Artificial Sequence
  Description of Artificial Sequence: Synthetic polynucleotide
  gnl|Fabrus|VH6-1_IGHD7-27*01_IGHJ4*01
ccatggcacaggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagctaactggggagactactttgactactggggccaaggaaccctggtcaccgtctcctcagctagc

SEQ ID NO: 1066 - DNA, 374 bp, Artificial Sequence
  Description of Artificial Sequence: Synthetic polynucleotide
  gnl|Fabrus|VH7-81_IGHD1-14*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatggtataaccggaaccacgactactttgactactggggccaaggaaccctggtcaccgtctcctcagctagc

SEQ ID NO: 1067 - DNA, 389 bp, Artificial Sequence
  Description of Artificial Sequence: Synthetic polynucleotide
  gnl|Fabrus|VH7-81_IGHD2-21*01_IGHJ2*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattcctactggtacttcgatctctggggccgtggcaccctggtcactgtctcctcagctagc

SEQ ID NO: 1068 - DNA, 401 bp, Artificial Sequence
  Description of Artificial Sequence: Synthetic polynucleotide
  gnl|Fabrus|VH7-81_IGHD2-21*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgcatattgtggtggtgattgctattccgattactactactactacggtatggacgtctgggggcaagggaccacggtcaccgtctcctcagctagc

SEQ ID NO: 1069 - DNA, 410 bp, Artificial Sequence
  Description of Artificial Sequence: Synthetic polynucleotide
  gnl|Fabrus|VH7-81_IGHD3-16*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatattattatgattacgtttgggggagttatgcttataccgattactactactactacggtatggacgtctgggggcaagggaccacggtcaccgtctcctcagctagc

SEQ ID NO: 1070 - DNA, 380 bp, Artificial Sequence
  Description of Artificial Sequence: Synthetic polynucleotide
  gnl|Fabrus|VH7-81_IGHD4-23*01_IGHJ1*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgactacggtggtaactccgctgaatacttccagcactggggccagggcaccctggtcaccgtctcctcagctagc

SEQ ID NO: 1071 - DNA, 395 bp, Artificial Sequence
  Description of Artificial Sequence: Synthetic polynucleotide
  gnl|Fabrus|VH7-81_IGHD5-12*01_IGHJ6*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatgtggatatagtggctacgattacgattactactactactacggtatggacgtctgggggcaagggaccacggtcaccgtctcctcagctagc

SEQ ID NO: 1072 - DNA, 377 bp, Artificial Sequence
  Description of Artificial Sequence: Synthetic polynucleotide
  gnl|Fabrus|VH7-81_IGHD6-25*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatatgggtatagcagcggctacgactactttgactactggggccaaggaaccctggtcaccgtctcctcagctagc

SEQ ID NO: 1073 - DNA, 368 bp, Artificial Sequence
  Description of Artificial Sequence: Synthetic polynucleotide
  gnl|Fabrus|VH7-81_IGHD7-27*01_IGHJ4*01
ccatggcacaggtgcagctggtgcagtctggccatgaggtgaagcagcctggggcctcagtgaaggtctcctgcaaggcttctggttacagtttcaccacctatggtatgaattgggtgccacaggcccctggacaagggcttgagtggatgggatggttcaacacctacactgggaacccaacatatgcccagggcttcacaggacggtttgtcttctcgatggacacctctgccagcacagcatacctgcagatcagcagcctaaaggctgaggacatggccatgtattactgtgcgagatctaactggggagactactttgactactggggccaaggaaccctggtcaccgtctcctcagctagc

SEQ ID NO: 1074 - DNA, 338 bp, Artificial Sequence
  Description of Artificial Sequence: Synthetic polynucleotide
  gnl|Fabrus|A14_IGKJ1*01
ccatggcggatgttgtgatgacacagtctccagctttcctctctgtgactccaggggagaaagtcaccatcacctgccaggccagtgaaggcattggcaactacttatactggtaccagcagaaaccagatcaagccccaaagctcctcatcaagtatgcttcccagtccatctcaggggtcccgtcgaggttcagtggcagtggatctgggacagatttcacctttaccatcagtagcctggaagctgaagatgctgcaacatattactgtcagcagggcaataagcaccctcagtggacgttcggccaagggaccaaggtggaaatcaaacgtact

SEQ ID NO: 1075 - DNA, 353 bp, Artificial Sequence
  Description of Artificial Sequence: Synthetic polynucleotide
  gnl|Fabrus|A17_IGKJ1*01
ccatggcggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaagacgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgtggacgttcggccaagggaccaaggtggaaatcaaacgtact

SEQ ID NO: 1076 - DNA, 353 bp, Artificial Sequence
  Description of Artificial Sequence: Synthetic polynucleotide
  gnl|Fabrus|A2_IGKJ1*01
ccatggcggatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctccgtggacgttcggccaagggaccaaggtggaaatcaaacgtact

SEQ ID NO: 1077 - DNA, 338 bp, Artificial Sequence
  Description of Artificial Sequence: Synthetic polynucleotide
  gnl|Fabrus|A20_IGKJ1*01
ccatggcggacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctccgtggacgttcggccaagggaccaaggtggaaatcaaacgtact

SEQ ID NO: 1078 - DNA, 353 bp, Artificial Sequence
  Description of Artificial Sequence: Synthetic polynucleotide
  gnl|Fabrus|A23_IGKJ1*01
ccatggcggatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctcagtggacgttcggccaagggaccaaggtggaaatcaaacgtact

SEQ ID NO: 1079 - DNA, 338 bp, Artificial Sequence
  Description of Artificial Sequence: Synthetic polynucleotide
  gnl|Fabrus|A26_IGKJ1*01
ccatggcggaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccgtcgaggttcagtggcagtggatctgggacagatttcaccctcaccatcaatagcctggaagctgaagatgctgcaacgtattactgtcatcagagtagtagtttacctcagtggacgttcggccaagggaccaaggtggaaatcaaacgtact

SEQ ID NO: 1080 - DNA, 341 bp, Artificial Sequence
  Description of Artificial Sequence: Synthetic polynucleotide
  gnl|Fabrus|A27_IGKJ1*01
ccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgtggacgttcggccaagggaccaaggtggaaatcaaacgtacg

SEQ ID NO: 1081 - DNA, 341 bp, Artificial Sequence
  Description of Artificial Sequence: Synthetic polynucleotide
  gnl|Fabrus|A27_IGKJ3*01
ccatggcggaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccattcactttcggccctgggaccaaagtggatatcaaacgtact

SEQ ID NO: 1082 - DNA, 338 bp, Artificial Sequence
  Description of Artificial Sequence: Synthetic polynucleotide
  gnl|Fabrus|A30_IGKJ1*01
ccatggcggacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaacgtact

SEQ ID NO: 1083 - DNA, 338 bp, Artificial Sequence
  Description of Artificial Sequence: Synthetic polynucleotide
  gnl|Fabrus|B2_IGKJ1*01
ccatggcggaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctgtggacgttcggccaagggaccaaggtggaaatcaaacgtact

SEQ ID NO: 1084 - DNA, 338 bp, Artificial Sequence
  Description of Artificial Sequence: Synthetic polynucleotide
  gnl|Fabrus|B2_IGKJ3*01
ccatggcggaaacgacactcacgcagtctccagcattcatgtcagcgactccaggagacaaagtcaacatctcctgcaaagccagccaagacattgatgatgatatgaactggtaccaacagaaaccaggagaagctgctattttcattattcaagaagctactactctcgttcctggaatcccacctcgattcagtggcagcgggtatggaacagattttaccctcacaattaataacatagaatctgaggatgctgcatattacttctgtctacaacatgataatttccctctattcactttcggccctgggaccaaagtggatatcaaacgtacg

SEQ ID NO: 1085 - DNA, 356 bp, Artificial Sequence
  Description of Artificial Sequence: Synthetic polynucleotide
  gnl|Fabrus|B3_IGKJ1*01
ccatggcggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgtggacgttcggccaagggaccaaggtggaaatcaaacgtact

SEQ ID NO: 1086 - DNA, 335 bp, Artificial Sequence
  Description of Artificial Sequence: Synthetic polynucleotide
  gnl|Fabrus|HerceptinLC
ccatggcggacattcagatgacccagagcccgagcagcctgagcgcgagcgtgggcgatcgtgtgaccattacctgccgtgccagccaggatgtgaacaccgcggtggcgtggtatcagcagaaaccgggtaaagccccgaaactgctgatttatagcgccagctttctgtatagcggcgtgccgagccgttttagcggtagccgcagcggcaccgattttaccctgaccattagcagcctgcagccggaagattttgccacctattattgccagcagcattataccaccccgccgacctttggccagggcaccaaagtggaaattaaacgtacg

SEQ ID NO: 1087 - DNA, 338 bp, Artificial Sequence
  Description of Artificial Sequence: Synthetic polynucleotide
  gnl|Fabrus|L11_IGKJ1*01
ccatggcggccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctccgtggacgttcggccaagggaccaaggtggaaatcaaacgtact

SEQ ID NO: 1088 - DNA, 338 bp, Artificial Sequence
  Description of Artificial Sequence: Synthetic polynucleotide
  gnl|Fabrus|L12_IGKJ1*01
ccatggcggacatccagatgacccagtctccttccaccctgtctgcatctgtaggagacagagtcaccatcacttgccgggccagtcagagtattagtagctggttggcctggtatcagcagaaaccagggaaagcccctaagctcctgatctatgatgcctccagtttggaaagtggggtcccatcaaggttcagcggcagtggatctgggacagaatttactctcaccatcagcagcctgcagcctgatgattttgcaacttattactgccaacagtataatagttattctccgtggacgttcggccaagggaccaaggtggaaatcaaacgtact

SEQ ID NO: 1089 - DNA, 338 bp, Artificial Sequence
  Description of Artificial Sequence: Synthetic polynucleotide
  gnl|Fabrus|L14_IGKJ1*01
ccatggcgaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaatttactctcacaatcagcagcctgcagcctgaagattttgcaacttattactgtctacagcataatagttaccctccgtggacgttcggccaagggaccaaggtggaaatcaaacgtact

SEQ ID NO: 1090 - DNA, 338 bp, Artificial Sequence
  Description of Artificial Sequence: Synthetic polynucleotide
  gnl|Fabrus|L2_IGKJ1*01
ccatggcggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtggacgttcggccaagggaccaaggtggaaatcaaacgtact

SEQ ID NO: 1091 - DNA, 338 bp, Artificial Sequence
  Description of Artificial Sequence: Synthetic polynucleotide
  gnl|Fabrus|L22_IGKJ3*01
ccatggcggacatccagatgatccagtctccatctttcctgtctgcatctgtaggagacagagtcagtatcatttgctgggcaagtgagggcattagcagtaatttagcctggtatctgcagaaaccagggaaatcccctaagctcttcctctatgatgcaaaagatttgcaccctggggtctcatcgaggttcagtggcaggggatctgggacggatttcactctcaccatcatcagcctgaagcctgaagattttgcagcttattactgtaaacaggacttcagttaccctccattcactttcggccctgggaccaaagtggatatcaaacgtacg

SEQ ID NO: 1092 - DNA, 338 bp, Artificial Sequence
  Description of Artificial Sequence: Synthetic polynucleotide
  gnl|Fabrus|L23_IGKJ1*01
ccatggcggccatccggatgacccagtctccattctccctgtctgcatctgtaggagacagagtcaccatcacttgctgggccagtcagggcattagcagttatttagcctggtatcagcaaaaaccagcaaaagcccctaagctcttcatctattatgcatccagtttgcaaagtggggtcccatcaaggttcagcggcagtggatctgggacggattacactctcaccatcagcagcctgcagcctgaagattttgcaacttattactgtcaacagtattatagtacccctccgtggacgttcggccaagggaccaaggtggaaatcaaacgtact

SEQ ID NO: 1093 - DNA, 341 bp, Artificial Sequence
  Description of Artificial Sequence: Synthetic polynucleotide
  gnl|Fabrus|L25_IGKJ1*01
ccatggcggaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccgtggacgttcggccaagggaccaaggtggaaatcaaacgtact

SEQ ID NO: 1094 - DNA, 341 bp, Artificial Sequence
  Description of Artificial Sequence: Synthetic polynucleotide
  gnl|Fabrus|L25_IGKJ3*01
ccatggcggaaattgtaatgacacagtctccagccaccctgtctttgtctccaggggaaagagccaccctctcctgcagggccagtcagagtgttagcagcagctacttatcctggtaccagcagaaacctgggcaggctcccaggctcctcatctatggtgcatccaccagggccactggcatcccagccaggttcagtggcagtgggtctgggacagacttcactctcaccatcagcagcctgcagcctgaagattttgcagtttattactgtcagcaggattataacttacctccattcactttcggccctgggaccaaagtggatatcaaacgtacg

SEQ ID NO: 1095 - DNA, 338 bp, Artificial Sequence
  Description of Artificial Sequence: Synthetic polynucleotide
  gnl|Fabrus|L4/18a_IGKJ1*01
ccatggcggccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatagttaccctcagtggacgttcggccaagggaccaaggtggaaatcaaacgtact

SEQ ID NO: 1096 - DNA, 338 bp, Artificial Sequence
  Description of Artificial Sequence: Synthetic polynucleotide
  gnl|Fabrus|L5_IGKJ1*01
ccatggcggacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgtggacgttcggccaagggaccaaggtggaaatcaaacgtact

SEQ ID NO: 1097 - DNA, 338 bp, Artificial Sequence
  Description of Artificial Sequence: Synthetic polynucleotide
  gnl|Fabrus|L6_IGKJ1*01
ccatggcggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgtggacgttcggccaagggaccaaggtggaaatcaaacgtact

SEQ ID NO: 1098 - DNA, 338 bp, Artificial Sequence
  Description of Artificial Sequence: Synthetic polynucleotide
  gnl|Fabrus|L8_IGKJ1*01
ccatggcggacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaatttactctcacaatcagcagcctgcagcctgaagattttgcaacttattactgtcaacagcttaatagttaccctccgtggacgttcggccaagggaccaaggtggaaatcaaacgtact

SEQ ID NO: 1099 - DNA, 338 bp, Artificial Sequence
  Description of Artificial Sequence: Synthetic polynucleotide
  gnl|Fabrus|L9_IGKJ2*01
ccatggcggccatccggatgacccagtctccatcctcattctctgcatctacaggagacagagtcaccatcacttgtcgggcgagtcagggtattagcagttatttagcctggtatcagcaaaaaccagggaaagcccctaagctcctgatctatgctgcatccactttgcaaagtggggtcccatcaaggttcagcggcagtggatctgggacagatttcactctcaccatcagctgcctgcagtctgaagattttgcaacttattactgtcaacagtattatagttaccctctgtatacttttggccaggggaccaagctggagatcaaacgtact

SEQ ID NO: 1100 - DNA, 356 bp, Artificial Sequence
  Description of Artificial Sequence: Synthetic polynucleotide
  gnl|Fabrus|O1_IGKJ1*01
ccatggcggatattgtgatgacccagactccactctccctgcccgtcacccctggagagccggcctccatctcctgcaggtctagtcagagcctcttggatagtgatgatggaaacacctatttggactggtacctgcagaagccagggcagtctccacagctcctgatctatacgctttcctatcgggcctctggagtcccagacaggttcagtggcagtgggtcaggcactgatttcacactgaaaatcagcagggtggaggctgaggatgttggagtttattactgcatgcaacgtatagagtttccttcgtggacgttcggccaagggaccaaggtggaaatcaaacgtact

SEQ ID NO: 1101 - DNA, 338 bp, Artificial Sequence
  Description of Artificial Sequence: Synthetic polynucleotide
  gnl|Fabrus|O12_IGKJ1*01
ccatggcggacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaacgtact

SEQ ID NO: 1102 - DNA, 338 bp, Artificial Sequence
  Description of Artificial Sequence: Synthetic polynucleotide
  gnl|Fabrus|O18_IGKJ1*01
ccatggcggacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccgtggacgttcggccaagggaccaaggtggaaatcaaacgtact

SEQ ID NO: 1103 - DNA, 330 bp, Artificial Sequence
  Description of Artificial Sequence: Synthetic polynucleotide
  gnl|Fabrus|Anti-CD20 LC
ccatggcggatcgtgctgagccagagccccgccatcctgagcgccagccccggcgagaaggtgaccatgacctgcagggccagcagcagcgtgagctacatgcactggtaccagcagaagcccggcagcagccccaagccctggatctacgcccccagcaacctggccagcggcgtgcccgccaggttcagcggcagcggcagcggcaccagctacagcctgaccatcagcagggtggaggccgaggacgccgccacctactactgccagcagtggagcttcaacccccccaccttcggcgccggcaccaagctggagctgaagcgtacg

SEQ ID NO: 1104 - DNA, 343 bp, Artificial Sequence
  Description of Artificial Sequence: Synthetic polynucleotide
  gnl|Fabrus|V1-11_IGLJ2*01
ccatggcgcagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtcctgtggtattcggcggagggaccaagctgaccgtcctagg

SEQ ID NO: 1105 - DNA, 346 bp, Artificial Sequence
  Description of Artificial Sequence: Synthetic polynucleotide
  gnl|Fabrus|V1-13_IGLJ5*01
ccatggcgcagtctgtgctgacgcagccgccctcagtgtctggggccccagggcagagggtcaccatctcctgcactgggagcagctccaacatcggggcaggttatgatgtgcactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcctgggtgtttggtgaggggaccgagctgaccgtcctagg

SEQ ID NO: 1106 - DNA, 343 bp, Artificial Sequence
  Description of Artificial Sequence: Synthetic polynucleotide
  gnl|Fabrus|V1-16_IGLJ6*01
ccatggcgcagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctaatgtgttcggcagtggcaccaaggtgaccgtcctagg

SEQ ID NO: 1107 - DNA, 346 bp, Artificial Sequence
  Description of Artificial Sequence: Synthetic polynucleotide
  gnl|Fabrus|V1-18_IGLJ2*01
ccatggcgcagtctgtgctgacgcagccgccctcagtgtctggggccccagggcagagggtcaccatctcctgcactgggagcagctccaacattggggcgggttatgttgtgcattggtaccagcagcttccaggaacagcccccaaactcctcatctatggtaacagcaatcggccctcaggggtccctgaccaattctctggctccaagtctggcacctcagcctccctggccatcactggactccagtctgaggatgaggctgattattactgcaaagcatgggataacagcctgaatgctcatgtggtattcggcggagggaccaagctgaccgtcctagg

SEQ ID NO: 1108 - DNA, 343 bp, Artificial Sequence
  Description of Artificial Sequence: Synthetic polynucleotide
  gnl|Fabrus|V1-2_IGLJ7*01
ccatggcgcagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttcgctgtgttcggaggaggcacccagctgaccgtcctagg

SEQ ID NO: 1109 - DNA, 343 bp, Artificial Sequence
  Description of Artificial Sequence: Synthetic polynucleotide
  gnl|Fabrus|V1-20_IGLJ6*01
ccatggcgcaggcagggctgactcagccaccctcggtgtccaagggcttgagacagaccgccacactcacctgcactgggaacagcaacattgttggcaaccaaggagcagcttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcattggacagcagcctcagtgctcataatgtgttcggcagtggcaccaaggtgaccgtcctagg

SEQ ID NO: 1110 - DNA, 343 bp, Artificial Sequence
  Description of Artificial Sequence: Synthetic polynucleotide
  gnl|Fabrus|V1-3_IGLJ1*01
ccatggcgcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttctatgtcttcggaactgggaccaaggtcaccgtcctagg

SEQ ID NO: 1111 - DNA, 343 bp, Artificial Sequence
  Description of Artificial Sequence: Synthetic polynucleotide
  gnl|Fabrus|V1-4_IGLJ4*01
ccatggcgcagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctctttgtatttggtggaggaacccagctgatcatcctagg

SEQ ID NO: 1112 - DNA, 343 bp, Artificial Sequence
  Description of Artificial Sequence: Synthetic polynucleotide
  gnl|Fabrus|V1-5_IGLJ2*01
ccatggcgcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagcttatatacaagcagcagcactttcgtggtattcggcggagggaccaagctgaccgtcctagg

SEQ ID NO: 1113 - DNA, 343 bp, Artificial Sequence
  Description of Artificial Sequence: Synthetic polynucleotide
  gnl|Fabrus|V1-7_IGLJ1*01
ccatggcgcagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcactttctatgtcttcggaactgggaccaaggtcaccgtcctagg

SEQ ID NO: 1114 - DNA, 343 bp, Artificial Sequence
  Description of Artificial Sequence: Synthetic polynucleotide
  gnl|Fabrus|V1-9_IGLJ6*01
ccatggcgcaatctgccctgactcagcctccttttgtgtccggggctcctggacagtcggtcaccatctcctgcactggaaccagcagtgacgttggggattatgatcatgtcttctggtaccaaaagcgtctcagcactacctccagactcctgatttacaatgtcaatactcggccttcagggatctctgacctcttctcaggctccaagtctggcaacatggcttccctgaccatctctgggctcaagtccgaggttgaggctaattatcactgcagcttatattcaagtagttacactttcaatgtgttcggcagtggcaccaaggtgaccgtcctagg

SEQ ID NO: 1115 - DNA, 331 bp, Artificial Sequence
  Description of Artificial Sequence: Synthetic polynucleotide
  gnl|Fabrus|V2-1_IGLJ6*01
ccatggcgtcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcaggcatccctgagcgattctctggctccaactctgggaacacagccactctgaccatcagcgggacccaggctatggatgaggctgactattactgtcaggcgtgggacagcagcactgcaaatgtgttcggcagtggcaccaaggtgaccgtcctagg

SEQ ID NO: 1116 - DNA, 337 bp, Artificial Sequence
  Description of Artificial Sequence: Synthetic polynucleotide
  gnl|Fabrus|V2-11_IGLJ7*01
ccatggcgtcctatgagctgacacagccaccctcggtgtcagtgtccctaggacagatggccaggatcacctgctctggagaagcattgccaaaaaaatatgcttattggtaccagcagaagccaggccagttccctgtgctggtgatatataaagacagcgagaggccctcaggcatccctgagcgattctctggctccagctcagggacaatagtcacattgaccatcagtggagtccaggcagaagacgaggctgactattactgtctatcagcagacagcagtggtacttatcctgctgtgttcggaggaggcacccagctgaccgtcctagg

SEQ ID NO: 1117 - DNA, 337 bp, Artificial Sequence
  Description of Artificial Sequence: Synthetic polynucleotide
  gnl|Fabrus|V2-13_IGLJ2*01
ccatggcgtcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcaggcatcccagaccgattctctggctccagctcaggaaacacagcttccttgaccatcactggggctcaggcggaagatgaggctgactattactgtaactcccgggacagcagtggtaaccatcttgtggtattcggcggagggaccaagctgaccgtcctagg

SEQ ID NO: 1118 - DNA, 337 bp, Artificial Sequence
  Description of Artificial Sequence: Synthetic polynucleotide
  gnl|Fabrus|V2-14_IGLJ4*01
ccatggcgtcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcaggcatccctgagcgattctctggctccaactctgggaacacggccaccctgaccatcagcagggtcgaagccggggatgaggccgactattactgtcaggtgtgggatagtagtagtgatcatccttttgtatttggtggaggaacccagctgatcatcctagg

SEQ ID NO: 1119 - DNA, 331 bp, Artificial Sequence
  Description of Artificial Sequence: Synthetic polynucleotide
  gnl|Fabrus|V2-15_IGLJ7*01
ccatggcgtcctatgagctgacacagctaccctcggtgtcagtgtccccaggacagacagccaggatcacctgctctggagatgtactgggggaaaattatgctgactggtaccagcagaagccaggccaggcccctgagttggtgatatacgaagatagtgagcggtaccctggaatccctgaacgattctctgggtccacctcagggaacacgaccaccctgaccatcagcagggtcctgaccgaagacgaggctgactattactgtttgtctggggatgaggacaatcctgctgtgttcggaggaggcacccagctgaccgtcctagg

SEQ ID NO: 1120 - DNA, 337 bp, Artificial Sequence
  Description of Artificial Sequence: Synthetic polynucleotide
  gnl|Fabrus|V2-17_IGLJ2*01
ccatggcgtcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcaggcatccctgagcgattctctggctccagctcagggacaacagtcacgttgaccatcagtggagtccaggcagaagatgaggctgactattactgtcaatcagcagacagcagtggtacttatcctgtggtattcggcggagggaccaagctgaccgtcctagg

SEQ ID NO: 1121 - DNA, 331 bp, Artificial Sequence
  Description of Artificial Sequence: Synthetic polynucleotide
  gnl|Fabrus|V2-19_IGLJ4*01
ccatggcgtcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcaggcatccctgagcgattctccggctccagctcagggaccacagtcaccttgaccatcagcggggcccaggttgaggatgaggctgactattactgttactctgcggctgacaacaatctttttgtatttggtggaggaacccagctgatcatcctagg

SEQ ID NO: 1122 - DNA, 331 bp, Artificial Sequence
  Description of Artificial Sequence: Synthetic polynucleotide
  gnl|Fabrus|V2-6_IGLJ4*01
ccatggcgtcctatgagctgactcagccactctcagtgtcagtggccctgggacagacggccaggattacctgtgggggaaacaacattggaagtaaaaatgtgcactggtaccagcagaagccaggccaggcccctgtgctggtcatctatagggatagcaaccggccctctggcatccctgagcgattctctggctccaactcggggaacacggccaccctgaccatcagcagagcccaagccggggatgaggctgactattactgtcaggtgtgggacagcagcactgcatttgtatttggtggaggaacccagctgatcatcctagg

SEQ ID NO: 1123 - DNA, 337 bp, Artificial Sequence
  Description of Artificial Sequence: Synthetic polynucleotide
  gnl|Fabrus|V2-7_IGLJ2*01
ccatggcgtcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgtggtattcggcggagggaccaagctgaccgtcctagg

SEQ ID NO: 1124 - DNA, 337 bp, Artificial Sequence
  Description of Artificial Sequence: Synthetic polynucleotide
  gnl|Fabrus|V2-7_IGLJ7*01
ccatggcgtcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccggcatccctgagagattctctggctccagctcagggacaatggccaccttgactatcagtggggcccaggtggaggatgaagctgactactactgttactcaacagacagcagtggtaatcatagtgctgtgttcggaggaggcacccagctgaccgtcctagg

SEQ ID NO: 1125 - DNA, 337 bp, Artificial Sequence
  Description of Artificial Sequence: Synthetic polynucleotide
  gnl|Fabrus|V2-8_IGLJ6*01
ccatggcgtcctatgagctgactcagccacactcagtgtcagtggccacagcacagatggccaggatcacctgtgggggaaacaacattggaagtaaagctgtgcactggtaccagcaaaagccaggccaggaccctgtgctggtcatctatagcgatagcaaccggccctcaggcatccctgagcgattctctggctccaacccagggaacaccgccaccctaaccatcagcaggatcgaggctggggatgaggctgactattactgtcaggtgtgggacagtagtagtgatcatcctaatgtgttcggcagtggcaccaaggtgaccgtcctagg

SEQ ID NO: 1126 - DNA, 340 bp, Artificial Sequence
  Description of Artificial Sequence: Synthetic polynucleotide
  gnl|Fabrus|V3-2_IGLJ4*01
ccatggcgcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaacaaacactcctggacccctgcccggttctcaggctccctccttgggggcaaagctgccctgacactgtcaggtgtgcagcctgaggacgaggctgagtattactgcctgctctactatggtggtgctcagtttgtatttggtggaggaacccagctgatcatcctagg

SEQ ID NO: 1127 - DNA, 340 bp, Artificial Sequence
  Description of Artificial Sequence: Synthetic polynucleotide
  gnl|Fabrus|V3-3_IGLJ7*01
ccatggcgcaggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacacctgcccggttctcaggctccctccttgggggcaaagctgccctgacccttttgggtgcgcagcctgaggatgaggctgagtattactgcttgctctcctatagtggtgctcgggctgtgttcggaggaggcacccagctgaccgtcctagg

SEQ ID NO: 1128 - DNA, 343 bp, Artificial Sequence
  Description of Artificial Sequence: Synthetic polynucleotide
  gnl|Fabrus|V3-4_IGLJ1*01
ccatggcgcagactgtggtgacccaggagccatcgttctcagtgtcccctggagggacagtcacactcacttgtggcttgagctctggctcagtctctactagttactaccccagctggtaccagcagaccccaggccaggctccacgcacgctcatctacagcacaaacactcgctcttctggggtccctgatcgcttctctggctccatccttgggaacaaagctgccctcaccatcacgggggcccaggcagatgatgaatctgattattactgtgtgctgtatatgggtagtggcatttcttatgtcttcggaactgggaccaaggtcaccgtcctagg

SEQ ID NO: 1129 - DNA, 358 bp, Artificial Sequence
  Description of Artificial Sequence: Synthetic polynucleotide
  gnl|Fabrus|V4-1_IGLJ4*01
ccatggcgcagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggagtccccagccgcttctctggctccaaagatgcttcagccaatacagggattttactcatctccgggctccagtctgaggatgaggctgactattactgtatgatttggccaagcaatgcttcttttgtatttggtggaggaacccagctgatcatcctagg

SEQ ID NO: 1130 - DNA, 358 bp, Artificial Sequence
  Description of Artificial Sequence: Synthetic polynucleotide
  gnl|Fabrus|V4-2_IGLJ4*01
ccatggcgcaggctgtgctgactcagccgtcttccctctctgcatctcctggagcatcagccagtctcacctgcaccttgcgcagtggcatcaatgttggtacctacaggatatactggtaccagcagaagccagggagtcctccccagtatctcctgaggtacaaatcagactcagataagcagcagggctctggagtccccagccgcttctctggctccaaagatgcttcggccaatgcagggattttactcatctctgggctccagtctgaggatgaggctgactattactgtatgatttggcacagcagcgcttcttttgtatttggtggaggaacccagctgatcatcctagg

SEQ ID NO: 1131 - DNA, 358 bp, Artificial Sequence
  Description of Artificial Sequence: Synthetic polynucleotide
  gnl|Fabrus|V4-3_IGLJ4*01
ccatggcgcagcctgtgctgactcagccaacttccctctcagcatctcctggagcatcagccagactcacctgcaccttgcgcagtggcatcaatcttggtagctacaggatattctggtaccagcagaagccagagagccctccccggtatctcctgagctactactcagactcaagtaagcatcagggctctggagtccccagccgcttctctggctccaaagatgcttcgagcaatgcagggattttagtcatctctgggctccagtctgaggatgaggctgactattactgtatgatttggcacagcagtgcttcttttgtatttggtggaggaacccagctgatcatcctagg

SEQ ID NO: 1132 - DNA, 364 bp, Artificial Sequence
  Description of Artificial Sequence: Synthetic polynucleotide
  gnl|Fabrus|V4-4_IGLJ5*01
ccatggcgcagcctgtgctgactcagccatcttcccattctgcatcttctggagcatcagtcagactcacctgcatgctgagcagtggcttcagtgttggggacttctggataaggtggtaccaacaaaagccagggaaccctccccggtatctcctgtactaccactcagactccaataagggccaaggctctggagttcccagccgcttctctggctccaacgatgcatcagccaatgcagggattctgcgtatctctgggctccagcctgaggatgaggctgactattactgtggtacatggcacagcaactctaagactcactgggtgtttggtgaggggaccgagctgaccgtcctagg

SEQ ID NO: 1133 - DNA, 358 bp, Artificial Sequence
  Description of Artificial Sequence: Synthetic polynucleotide
  gnl|Fabrus|V4-6_IGLJ4*01
ccatggcgcggcccgtgctgactcagccgccctctctgtctgcatccccgggagcaacagccagactcccctgcaccctgagcagtgacctcagtgttggtggtaaaaacatgttctggtaccagcagaagccagggagctctcccaggttattcctgtatcactactcagactcagacaagcagctgggacctggggtccccagtcgagtctctggctccaaggagacctcaagtaacacagcgtttttgctcatctctgggctccagcctgaggacgaggccgattattactgccaggtgtacgaaagtagtgctaattttgtatttggtggaggaacccagctgatcatcctagg

SEQ ID NO: 1134 - DNA, 346 bp, Artificial Sequence
  Description of Artificial Sequence: Synthetic polynucleotide
  gnl|Fabrus|V5-4_IGLJ2*01
ccatggcgcagcctgtgctgactcaatcatcctctgcctctgcttccctgggctcctcggtcaagctcacctgcactctgagcagtgggcacagtagctacatcatcgcatggcatcagcagcagccagggaaggcccctcggtacttgatgaagcttgaaggtagtggaagctacaacaaggggagcggagttcctgatcgcttctcaggctccagctctggggctgaccgctacctcaccatctccaacctccagtttgaggatgaggctgattattactgtgagacctgggacagtaacactcatgtggtattcggcggagggaccaagctgaccgtcctagg

SEQ ID NO: 1135 - DNA, 346 bp, Artificial Sequence
  Description of Artificial Sequence: Synthetic polynucleotide
  gnl|Fabrus|V5-6_IGLJ1*01
ccatggcgcagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacggcatccctgatcgcttctcaggctccagctctggggctgagcgctacctcaccatctccagcctccagtctgaggatgaggctgactattactgtcagacctggggcactggcattcattatgtcttcggaactgggaccaaggtcaccgtcctagg

SEQ ID NO: 1136 - DNA, 383 bp, Artificial Sequence
  Description of Artificial Sequence: Synthetic polynucleotide
  gi|Fabrus|A01_VH3-23_IGHD1-1*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctacgctgaatacttccagcactggggccaaggaaccctggtcaccgtctcctcagctagc

SEQ ID NO: 1137 - DNA, 383 bp, Artificial Sequence
  Description of Artificial Sequence: Synthetic polynucleotide
  gi|Fabrus|A02_VH3-23_IGHD1-1*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctacgctgaatacttccagcactggggccaaggaaccctggtcaccgtctcctcagctagc

SEQ ID NO: 1138 - DNA, 383 bp, Artificial Sequence
  Description of Artificial Sequence: Synthetic polynucleotide
  gi|Fabrus|A03_VH3-23_IGHD1-1*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctacgctgaatacttccagcactggggccaaggaaccctggtcaccgtctcctcagctagc

SEQ ID NO: 1139 - DNA, 383 bp, Artificial Sequence
  Description of Artificial Sequence: Synthetic polynucleotide
  gi|Fabrus|A04_VH3-23_IGHD1-7*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctacgctgaatacttccagcactggggccaaggaaccctggtcaccgtctcctcagctagc

SEQ ID NO: 1140 - DNA, 383 bp, Artificial Sequence
  Description of Artificial Sequence: Synthetic polynucleotide
  gi|Fabrus|A05_VH3-23_IGHD1-7*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctacgctgaatacttccagcactggggccaaggaaccctggtcaccgtctcctcagctagc

SEQ ID NO: 1141 - DNA, 383 bp, Artificial Sequence
  Description of Artificial Sequence: Synthetic polynucleotide
  gi|Fabrus|A06_VH3-23_IGHD1-14*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctacgctgaatacttccagcactggggccaaggaaccctggtcaccgtctcctcagctagc

SEQ ID NO: 1142 - DNA, 383 bp, Artificial Sequence
  Description of Artificial Sequence: Synthetic polynucleotide
  gi|Fabrus|A07_VH3-23_IGHD1-14*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctacgctgaatacttccagcactggggccaaggaaccctggtcaccgtctcctcagctagc

SEQ ID NO: 1143 - DNA, 383 bp, Artificial Sequence
  Description of Artificial Sequence: Synthetic polynucleotide
  gi|Fabrus|A08_VH3-23_IGHD1-20*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctacgctgaatacttccagcactggggccaaggaaccctggtcaccgtctcctcagctagc

SEQ ID NO: 1144 - DNA, 383 bp, Artificial Sequence
  Description of Artificial Sequence: Synthetic polynucleotide
  gi|Fabrus|A09_VH3-23_IGHD1-20*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctacgctgaatacttccagcactggggccaaggaaccctggtcaccgtctcctcagctagc

SEQ ID NO: 1145 - DNA, 386 bp, Artificial Sequence
  Description of Artificial Sequence: Synthetic polynucleotide
  gi|Fabrus|A10_VH3-23_IGHD1-26*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctacgctgaatacttccagcactggggccaaggaaccctggtcaccgtctcctcagctagc

SEQ ID NO: 1146 - DNA, 386 bp, Artificial Sequence
  Description of Artificial Sequence: Synthetic polynucleotide
  gi|Fabrus|A11_VH3-23_IGHD1-26*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctacgctgaatacttccagcactggggccaaggaaccctggtcaccgtctcctcagctagc

SEQ ID NO: 1147 - DNA, 395 bp, Artificial Sequence
  Description of Artificial Sequence: Synthetic polynucleotide
  gi|Fabrus|A12_VH3-23_IGHD2-2*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctacgctgaatacttccagcactggggccaaggaaccctggtcaccgtctcctcagctagc

SEQ ID NO: 1148 - DNA, 395 bp, Artificial Sequence
  Description of Artificial Sequence: Synthetic polynucleotide
  gi|Fabrus|B01_VH3-23_IGHD2-2*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctacgctgaatacttccagcactggggccaaggaaccctggtcaccgtctcctcagctagc

SEQ ID NO: 1149 - DNA, 395 bp, Artificial Sequence
  Description of Artificial Sequence: Synthetic polynucleotide
  gi|Fabrus|B02_VH3-23_IGHD2-8*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctacgctgaatacttccagcactggggccaaggaaccctggtcaccgtctcctcagctagc

SEQ ID NO: 1150 - DNA, 395 bp, Artificial Sequence
  Description of Artificial Sequence: Synthetic polynucleotide
  gi|Fabrus|B03_VH3-23_IGHD2-8*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctacgctgaatacttccagcactggggccaaggaaccctggtcaccgtctcctcagctagc

SEQ ID NO: 1151 - DNA, 395 bp, Artificial Sequence
  Description of Artificial Sequence: Synthetic polynucleotide
  gi|Fabrus|B04_VH3-23_IGHD2-15*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctacgctgaatacttccagcactggggccaaggaaccctggtcaccgtctcctcagctagc

SEQ ID NO: 1152 - DNA, 395 bp, Artificial Sequence
  Description of Artificial Sequence: Synthetic polynucleotide
  gi|Fabrus|B05_VH3-23_IGHD2-15*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctacgctgaatacttccagcactggggccaaggaaccctggtcaccgtctcctcagctagc

SEQ ID NO: 1153 - DNA, 392 bp, Artificial Sequence
  Description of Artificial Sequence: Synthetic polynucleotide
  gi|Fabrus|B06_VH3-23_IGHD2-21*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctacgctgaatacttccagcactggggccaaggaaccctggtcaccgtctcctcagctagc

SEQ ID NO: 1154 - DNA, 392 bp, Artificial Sequence
  Description of Artificial Sequence: Synthetic polynucleotide
  gi|Fabrus|B07_VH3-23_IGHD2-21*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctacgctgaatacttccagcactggggccaaggaaccctggtcaccgtctcctcagctagc

SEQ ID NO: 1155 - DNA, 395 bp, Artificial Sequence
  Description of Artificial Sequence: Synthetic polynucleotide
  gi|Fabrus|B08_VH3-23_IGHD3-3*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctacgctgaatacttccagcactggggccaaggaaccctggtcaccgtctcctcagctagc

SEQ ID NO: 1156 - DNA, 395 bp, Artificial Sequence
  Description of Artificial Sequence: Synthetic polynucleotide
  gi|Fabrus|B09_VH3-23_IGHD3-3*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctacgctgaatacttccagcactggggccaaggaaccctggtcaccgtctcctcagctagc

SEQ ID NO: 1157 - DNA, 395 bp, Artificial Sequence
  Description of Artificial Sequence: Synthetic polynucleotide
  gi|Fabrus|B10_VH3-23_IGHD3-3*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctacgctgaatacttccagcactggggccaaggaaccctggtcaccgtctcctcagctagc

SEQ ID NO: 1158 - DNA, 395 bp, Artificial Sequence
  Description of Artificial Sequence: Synthetic polynucleotide
  gi|Fabrus|B11_VH3-23_IGHD3-9*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctacgctgaatacttccagcactggggccaaggaaccctggtcaccgtctcctcagctagc

SEQ ID NO: 1159 - DNA, 395 bp, Artificial Sequence
  Description of Artificial Sequence: Synthetic polynucleotide
  gi|Fabrus|B12_VH3-23_IGHD3-10*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctacgctgaatacttccagcactggggccaaggaaccctggtcaccgtctcctcagctagc

SEQ ID NO: 1160 - DNA, 395 bp, Artificial Sequence
  Description of Artificial Sequence: Synthetic polynucleotide
  gi|Fabrus|C01_VH3-23_IGHD3-10*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctacgctgaatacttccagcactggggccaaggaaccctggtcaccgtctcctcagctagc

SEQ ID NO: 1161 - DNA, 401 bp, Artificial Sequence
  Description of Artificial Sequence: Synthetic polynucleotide
  gi|Fabrus|C02_VH3-23_IGHD3-16*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctacgctgaatacttccagcactggggccaaggaaccctggtcaccgtctcctcagctagc

SEQ ID NO: 1162 - DNA, 401 bp, Artificial Sequence
  Description of Artificial Sequence: Synthetic polynucleotide
  gi|Fabrus|C03_VH3-23_IGHD3-16*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctacgctgaatacttccagcactggggccaaggaaccctggtcaccgtctcctcagctagc

SEQ ID NO: 1163 - DNA, 395 bp, Artificial Sequence
  Description of Artificial Sequence: Synthetic polynucleotide
  gi|Fabrus|C04_VH3-23_IGHD3-22*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctacgctgaatacttccagcactggggccaaggaaccctggtcaccgtctcctcagctagc

SEQ ID NO: 1164 - DNA, 395 bp, Artificial Sequence
  Description of Artificial Sequence: Synthetic polynucleotide
  gi|Fabrus|C05_VH3-23_IGHD3-22*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctacgctgaatacttccagcactggggccaaggaaccctggtcaccgtctcctcagctagc

SEQ ID NO: 1165 - DNA, 380 bp, Artificial Sequence
  Description of Artificial Sequence: Synthetic polynucleotide
  gi|Fabrus|C06_VH3-23_IGHD4-4*01(1)>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctacgctgaatacttccagcactggggccaaggaaccctggtcaccgtctcctcagctagc

SEQ ID NO: 1166 - DNA, 380 bp, Artificial Sequence
  Description of Artificial Sequence: Synthetic polynucleotide
  gi|Fabrus|C07_VH3-23_IGHD4-4*01(1)>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctacgctgaatacttccagcactggggccaaggaaccctggtcaccgtctcctcagctagc

SEQ ID NO: 1167 - DNA, 380 bp, Artificial Sequence; identical to SEQ ID NO: 1165
  Description of Artificial Sequence: Synthetic polynucleotide
  gi|Fabrus|C08_VH3-23_IGHD4-11*01(1)>2_IGHJ1*01

SEQ ID NO: 1168 - DNA, 380 bp, Artificial Sequence; identical to SEQ ID NO: 1166
  Description of Artificial Sequence: Synthetic polynucleotide
  gi|Fabrus|C09_VH3-23_IGHD4-11*01(1)>3_IGHJ1*01

SEQ ID NO: 1169 - DNA, 380 bp, Artificial Sequence
  Description of Artificial Sequence: Synthetic polynucleotide
  gi|Fabrus|C10_VH3-23_IGHD4-17*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctacgctgaatacttccagcactggggccaaggaaccctggtcaccgtctcctcagctagc

SEQ ID NO: 1170 - DNA, 380 bp, Artificial Sequence
  Description of Artificial Sequence: Synthetic polynucleotide
  gi|Fabrus|C11_VH3-23_IGHD4-17*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctacgctgaatacttccagcactggggccaaggaaccctggtcaccgtctcctcagctagc

SEQ ID NO: 1171 - DNA, 383 bp, Artificial Sequence
  Description of Artificial Sequence: Synthetic polynucleotide
  gi|Fabrus|C12_VH3-23_IGHD4-23*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctacgctgaatacttccagcactggggccaaggaaccctggtcaccgtctcctcagctagc

SEQ ID NO: 1172 - DNA, 383 bp, Artificial Sequence
  Description of Artificial Sequence: Synthetic polynucleotide
  gi|Fabrus|D01_VH3-23_IGHD4-23*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctacgctgaatacttccagcactggggccaaggaaccctggtcaccgtctcctcagctagc

SEQ ID NO: 1173 - DNA, 386 bp, Artificial Sequence
  Description of Artificial Sequence: Synthetic polynucleotide
  gi|Fabrus|D02_VH3-23_IGHD5-5*01(2)>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctacgctgaatacttccagcactggggccaaggaaccctggtcaccgtctcctcagctagc

SEQ ID NO: 1174 - DNA, 386 bp, Artificial Sequence
  Description of Artificial Sequence: Synthetic polynucleotide
  gi|Fabrus|D03_VH3-23_IGHD5-5*01(2)>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctacgctgaatacttccagcactggggccaaggaaccctggtcaccgtctcctcagctagc

SEQ ID NO: 1175 - DNA, 386 bp, Artificial Sequence
  Description of Artificial Sequence: Synthetic polynucleotide
  gi|Fabrus|D04_VH3-23_IGHD5-5*01(2)>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctacgctgaatacttccagcactggggccaaggaaccctggtcaccgtctcctcagctagc

SEQ ID NO: 1176 - DNA, 389 bp, Artificial Sequence
  Description of Artificial Sequence: Synthetic polynucleotide
  gi|Fabrus|D05_VH3-23_IGHD5-12*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctacgctgaatacttccagcactggggccaaggaaccctggtcaccgtctcctcagctagc

SEQ ID NO: 1177 - DNA, 389 bp, Artificial Sequence
  Description of Artificial Sequence: Synthetic polynucleotide
  gi|Fabrus|D06_VH3-23_IGHD5-12*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctacgctgaatacttccagcactggggccaaggaaccctggtcaccgtctcctcagctagc

SEQ ID NO: 1178 - DNA, 386 bp, Artificial Sequence; identical to SEQ ID NO: 1173
  Description of Artificial Sequence: Synthetic polynucleotide
  gi|Fabrus|D07_VH3-23_IGHD5-18*01(2)>1_IGHJ1*01

SEQ ID NO: 1179 - DNA, 386 bp, Artificial Sequence; identical to SEQ ID NO: 1174
  Description of Artificial Sequence: Synthetic polynucleotide
  gi|Fabrus|D08_VH3-23_IGHD5-18*01(2)>2_IGHJ1*01

SEQ ID NO: 1180 - DNA, 386 bp, Artificial Sequence; identical to SEQ ID NO: 1175
  Description of Artificial Sequence: Synthetic polynucleotide
  gi|Fabrus|D09_VH3-23_IGHD5-18*01(2)>3_IGHJ1*01

SEQ ID NO: 1181 - DNA, 386 bp, Artificial Sequence
  Description of Artificial Sequence: Synthetic polynucleotide
  gi|Fabrus|D10_VH3-23_IGHD5-24*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctacgctgaatacttccagcactggggccaaggaaccctggtcaccgtctcctcagctagc

SEQ ID NO: 1182 - DNA, 386 bp, Artificial Sequence
  Description of Artificial Sequence: Synthetic polynucleotide
  gi|Fabrus|D11_VH3-23_IGHD5-24*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctacgctgaatacttccagcactggggccaaggaaccctggtcaccgtctcctcagctagc

SEQ ID NO: 1183 - DNA, 383 bp, Artificial Sequence
  Description of Artificial Sequence: Synthetic polynucleotide
  gi|Fabrus|D12_VH3-23_IGHD6-6*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctacgctgaatacttccagcactggggccaaggaaccctggtcaccgtctcctcagctagc

SEQ ID NO: 1184 - DNA, 383 bp, Artificial Sequence
  Description of Artificial Sequence: Synthetic polynucleotide
  gi|Fabrus|E01_VH3-23_IGHD6-6*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctacgctgaatacttccagcactggggccaaggaaccctggtcaccgtctcctcagctagc

SEQ ID NO: 1185 - DNA, 386 bp, Artificial Sequence
  Description of Artificial Sequence: Synthetic polynucleotide
  gi|Fabrus|E02_VH3-23_IGHD6-13*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctacgctgaatacttccagcactggggccaaggaaccctggtcaccgtctcctcagctagc

SEQ ID NO: 1186 - DNA, 386 bp, Artificial Sequence
  Description of Artificial Sequence: Synthetic polynucleotide
  gi|Fabrus|E03_VH3-23_IGHD6-13*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctacgctgaatacttccagcactggggccaaggaaccctggtcaccgtctcctcagctagc

SEQ ID NO: 1187 - DNA, 386 bp, Artificial Sequence
  Description of Artificial Sequence: Synthetic polynucleotide
  gi|Fabrus|E04_VH3-23_IGHD6-19*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctacgctgaatacttccagcactggggccaaggaaccctggtcaccgtctcctcagctagc

SEQ ID NO: 1188 - DNA, 386 bp, Artificial Sequence
  Description of Artificial Sequence: Synthetic polynucleotide
  gi|Fabrus|E05_VH3-23_IGHD6-19*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctacgctgaatacttccagcactggggccaaggaaccctggtcaccgtctcctcagctagc

SEQ ID NO: 1189 - DNA, 383 bp, Artificial Sequence
  Description of Artificial Sequence: Synthetic polynucleotide
  gi|Fabrus|E06_VH3-23_IGHD6-25*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctacgctgaatacttccagcactggggccaaggaaccctggtcaccgtctcctcagctagc

SEQ ID NO: 1190 - DNA, 383 bp, Artificial Sequence
  Description of Artificial Sequence: Synthetic polynucleotide
  gi|Fabrus|E07_VH3-23_IGHD6-25*01>2_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctacgctgaatacttccagcactggggccaaggaaccctggtcaccgtctcctcagctagc

SEQ ID NO: 1191 - DNA, 377 bp, Artificial Sequence
  Description of Artificial Sequence: Synthetic polynucleotide
  gi|Fabrus|E08_VH3-23_IGHD7-27*01>1_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctacgctgaatacttccagcactggggccaaggaaccctggtcaccgtctcctcagctagc

SEQ ID NO: 1192 - DNA, 377 bp, Artificial Sequence
  Description of Artificial Sequence: Synthetic polynucleotide
  gi|Fabrus|E09_VH3-23_IGHD7-27*01>3_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctacgctgaatacttccagcactggggccaaggaaccctggtcaccgtctcctcagctagc

SEQ ID NO: 1193 - DNA, 383 bp, Artificial Sequence
  Description of Artificial Sequence: Synthetic polynucleotide
  gi|Fabrus|A01_VH3-23_IGHD1-1*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctacgctgaatacttccagcactggggccaaggaaccctggtcaccgtctcctcagctagc

SEQ ID NO: 1194 - DNA, 383 bp, Artificial Sequence
  Description of Artificial Sequence: Synthetic polynucleotide
  gi|Fabrus|A02_VH3-23_IGHD1-1*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctacgctgaatacttccagcactggggccaaggaaccctggtcaccgtctcctcagctagc

SEQ ID NO: 1195 - DNA, 383 bp, Artificial Sequence
  Description of Artificial Sequence: Synthetic polynucleotide
  gi|Fabrus|A03_VH3-23_IGHD1-1*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctacgctgaatacttccagcactggggccaaggaaccctggtcaccgtctcctcagctagc

SEQ ID NO: 1196 - DNA, 383 bp, Artificial Sequence
  Description of Artificial Sequence: Synthetic polynucleotide
  gi|Fabrus|A04_VH3-23_IGHD1-7*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctacgctgaatacttccagcactggggccaaggaaccctggtcaccgtctcctcagctagc

SEQ ID NO: 1197 - DNA, 383 bp, Artificial Sequence
  Description of Artificial Sequence: Synthetic polynucleotide
  gi|Fabrus|A05_VH3-23_IGHD1-7*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctacgctgaatacttccagcactggggccaaggaaccctggtcaccgtctcctcagctagc

SEQ ID NO: 1198 - DNA, 383 bp, Artificial Sequence
  Description of Artificial Sequence: Synthetic polynucleotide
  gi|Fabrus|A06_VH3-23_IGHD1-14*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctacgctgaatacttccagcactggggccaaggaaccctggtcaccgtctcctcagctagc

SEQ ID NO: 1199 - DNA, 383 bp, Artificial Sequence
  Description of Artificial Sequence: Synthetic polynucleotide
  gi|Fabrus|A07_VH3-23_IGHD1-14*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctacgctgaatacttccagcactggggccaaggaaccctggtcaccgtctcctcagctagc

SEQ ID NO: 1200 - DNA, 383 bp, Artificial Sequence
  Description of Artificial Sequence: Synthetic polynucleotide
  gi|Fabrus|A08_VH3-23_IGHD1-14*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctacgctgaatacttccagcactggggccaaggaaccctggtcaccgtctcctcagctagc

SEQ ID NO: 1201 - DNA, 383 bp, Artificial Sequence
  Description of Artificial Sequence: Synthetic polynucleotide
  gi|Fabrus|A09_VH3-23_IGHD1-20*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctacgctgaatacttccagcactggggccaaggaaccctggtcaccgtctcctcagctagc

SEQ ID NO: 1202 - DNA, 383 bp, Artificial Sequence
  Description of Artificial Sequence: Synthetic polynucleotide
  gi|Fabrus|A10_VH3-23_IGHD1-20*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctacgctgaatacttccagcactggggccaaggaaccctggtcaccgtctcctcagctagc

SEQ ID NO: 1203 - DNA, 383 bp, Artificial Sequence
  Description of Artificial Sequence: Synthetic polynucleotide
  gi|Fabrus|A11_VH3-23_IGHD1-20*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctacgctgaatacttccagcactggggccaaggaaccctggtcaccgtctcctcagctagc

SEQ ID NO: 1204 - DNA, 386 bp, Artificial Sequence
  Description of Artificial Sequence: Synthetic polynucleotide
  gi|Fabrus|A12_VH3-23_IGHD1-26*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctacgctgaatacttccagcactggggccaaggaaccctggtcaccgtctcctcagctagc

SEQ ID NO: 1205 - DNA, 386 bp, Artificial Sequence
  Description of Artificial Sequence: Synthetic polynucleotide
  gi|Fabrus|B01_VH3-23_IGHD1-26*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctacgctgaatacttccagcactggggccaaggaaccctggtcaccgtctcctcagctagc

SEQ ID NO: 1206 - DNA, 395 bp, Artificial Sequence
  Description of Artificial Sequence: Synthetic polynucleotide
  gi|Fabrus|B02_VH3-23_IGHD2-2*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctacgctgaatacttccagcactggggccaaggaaccctggtcaccgtctcctcagctagc

SEQ ID NO: 1207 - DNA, 395 bp, Artificial Sequence
  Description of Artificial Sequence: Synthetic polynucleotide
  gi|Fabrus|B03_VH3-23_IGHD2-2*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctacgctgaatacttccagcactggggccaaggaaccctggtcaccgtctcctcagctagc

SEQ ID NO: 1208 - DNA, 395 bp, Artificial Sequence
  Description of Artificial Sequence: Synthetic polynucleotide
  gi|Fabrus|B04_VH3-23_IGHD2-8*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctacgctgaatacttccagcactggggccaaggaaccctggtcaccgtctcctcagctagc

SEQ ID NO: 1209 - DNA, 395 bp, Artificial Sequence
  Description of Artificial Sequence: Synthetic polynucleotide
  gi|Fabrus|B05_VH3-23_IGHD2-15*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctacgctgaatacttccagcactggggccaaggaaccctggtcaccgtctcctcagctagc

SEQ ID NO: 1210 - DNA, 395 bp, Artificial Sequence
  Description of Artificial Sequence: Synthetic polynucleotide
  gi|Fabrus|B06_VH3-23_IGHD2-15*01>3'_IGHJ1*0
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctacgctgaatacttccagcactggggccaaggaaccctggtcaccgtctcctcagctagc

SEQ ID NO: 1211 - DNA, 392 bp, Artificial Sequence
  Description of Artificial Sequence: Synthetic polynucleotide
  gi|Fabrus|B07_VH3-23_IGHD2-21*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctacgctgaatacttccagcactggggccaaggaaccctggtcaccgtctcctcagctagc

SEQ ID NO: 1212 - DNA, 392 bp, Artificial Sequence
  Description of Artificial Sequence: Synthetic polynucleotide
  gi|Fabrus|B08_VH3-23_IGHD2-21*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctacgctgaatacttccagcactggggccaaggaaccctggtcaccgtctcctcagctagc

SEQ ID NO: 1213 - DNA, 395 bp, Artificial Sequence
  Description of Artificial Sequence: Synthetic polynucleotide
  gi|Fabrus|B09_VH3-23_IGHD3-3*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctacgctgaatacttccagcactggggccaaggaaccctggtcaccgtctcctcagctagc

SEQ ID NO: 1214 - DNA, 395 bp, Artificial Sequence
  Description of Artificial Sequence: Synthetic polynucleotide
  gi|Fabrus|B10_VH3-23_IGHD3-3*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctacgctgaatacttccagcactggggccaaggaaccctggtcaccgtctcctcagctagc

SEQ ID NO: 1215 - DNA, 395 bp, Artificial Sequence
  Description of Artificial Sequence: Synthetic polynucleotide
  gi|Fabrus|B11_VH3-23_IGHD3-9*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctacgctgaatacttccagcactggggccaaggaaccctggtcaccgtctcctcagctagc

SEQ ID NO: 1216 - DNA, 395 bp, Artificial Sequence
  Description of Artificial Sequence: Synthetic polynucleotide
  gi|Fabrus|B12_VH3-23_IGHD3-9*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctacgctgaatacttccagcactggggccaaggaaccctggtcaccgtctcctcagctagc

SEQ ID NO: 1217 - DNA, 395 bp, Artificial Sequence
  Description of Artificial Sequence: Synthetic polynucleotide
  gi|Fabrus|C01_VH3-23_IGHD3-10*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctacgctgaatacttccagcactggggccaaggaaccctggtcaccgtctcctcagctagc

SEQ ID NO: 1218 - DNA, 395 bp, Artificial Sequence
  Description of Artificial Sequence: Synthetic polynucleotide
  gi|Fabrus|C02_VH3-23_IGHD3-10*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctacgctgaatacttccagcactggggccaaggaaccctggtcaccgtctcctcagctagc

SEQ ID NO: 1219 - DNA, 401 bp, Artificial Sequence
  Description of Artificial Sequence: Synthetic polynucleotide
  gi|Fabrus|C03_VH3-23_IGHD3-16*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctacgctgaatacttccagcactggggccaaggaaccctggtcaccgtctcctcagctagc

SEQ ID NO: 1220 - DNA, 401 bp, Artificial Sequence
  Description of Artificial Sequence: Synthetic polynucleotide
  gi|Fabrus|C04_VH3-23_IGHD3-16*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctacgctgaatacttccagcactggggccaaggaaccctggtcaccgtctcctcagctagc

SEQ ID NO: 1221 - DNA, 395 bp, Artificial Sequence
  Description of Artificial Sequence: Synthetic polynucleotide
  gi|Fabrus|C05_VH3-23_IGHD3-22*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctacgctgaatacttccagcactggggccaaggaaccctggtcaccgtctcctcagctagc

SEQ ID NO: 1222 - DNA, 380 bp, Artificial Sequence
  Description of Artificial Sequence: Synthetic polynucleotide
  gi|Fabrus|C06_VH3-23_IGHD4-4*01(1)>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctacgctgaatacttccagcactggggccaaggaaccctggtcaccgtctcctcagctagc

SEQ ID NO: 1223 - DNA, 380 bp, Artificial Sequence
  Description of Artificial Sequence: Synthetic polynucleotide
  gi|Fabrus|C07_VH3-23_IGHD4-4*01(1)>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctacgctgaatacttccagcactggggccaaggaaccctggtcaccgtctcctcagctagc

SEQ ID NO: 1224 - DNA, 380 bp, Artificial Sequence; identical to SEQ ID NO: 1222
  Description of Artificial Sequence: Synthetic polynucleotide
  gi|Fabrus|C08_VH3-23_IGHD4-11*01(1)>1'_IGHJ1*01

SEQ ID NO: 1225 - DNA, 380 bp, Artificial Sequence; identical to SEQ ID NO: 1223
  Description of Artificial Sequence: Synthetic polynucleotide
  gi|Fabrus|C09_VH3-23_IGHD4-11*01(1)>3'_IGHJ1*01

SEQ ID NO: 1226 - DNA, 380 bp, Artificial Sequence
  Description of Artificial Sequence: Synthetic polynucleotide
  gi|Fabrus|C10_VH3-23_IGHD4-17*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctacgctgaatacttccagcactggggccaaggaaccctggtcaccgtctcctcagctagc

SEQ ID NO: 1227 - DNA, 380 bp, Artificial Sequence
  Description of Artificial Sequence: Synthetic polynucleotide
  gi|Fabrus|C11_VH3-23_IGHD4-17*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctacgctgaatacttccagcactggggccaaggaaccctggtcaccgtctcctcagctagc

SEQ ID NO: 1228 - DNA, 383 bp, Artificial Sequence
  Description of Artificial Sequence: Synthetic polynucleotide
  gi|Fabrus|C12_VH3-23_IGHD4-23*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctacgctgaatacttccagcactggggccaaggaaccctggtcaccgtctcctcagctagc

SEQ ID NO: 1229 - DNA, 383 bp, Artificial Sequence
  Description of Artificial Sequence: Synthetic polynucleotide
  gi|Fabrus|D01_VH3-23_IGHD4-23*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctacgctgaatacttccagcactggggccaaggaaccctggtcaccgtctcctcagctagc

SEQ ID NO: 1230 - DNA, 386 bp, Artificial Sequence
  Description of Artificial Sequence: Synthetic polynucleotide
  gi|Fabrus|D02_VH3-23_IGHD5-5*01(2)>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctacgctgaatacttccagcactggggccaaggaaccctggtcaccgtctcctcagctagc

SEQ ID NO: 1231 - DNA, 386 bp, Artificial Sequence
  Description of Artificial Sequence: Synthetic polynucleotide
  gi|Fabrus|D03_VH3-23_IGHD5-5*01(2)>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctacgctgaatacttccagcactggggccaaggaaccctggtcaccgtctcctcagctagc

SEQ ID NO: 1232 - DNA, 389 bp, Artificial Sequence
  Description of Artificial Sequence: Synthetic polynucleotide
  gi|Fabrus|D04_VH3-23_IGHD5-12*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctacgctgaatacttccagcactggggccaaggaaccctggtcaccgtctcctcagctagc

SEQ ID NO: 1233 - DNA, 389 bp, Artificial Sequence
  Description of Artificial Sequence: Synthetic polynucleotide
  gi|Fabrus|D05_VH3-23_IGHD5-12*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctacgctgaatacttccagcactggggccaaggaaccctggtcaccgtctcctcagctagc

SEQ ID NO: 1234 - DNA, 386 bp, Artificial Sequence; identical to SEQ ID NO: 1230
  Description of Artificial Sequence: Synthetic polynucleotide
  gi|Fabrus|D06_VH3-23_IGHD5-18*01(2)>1'_IGHJ1*01

SEQ ID NO: 1235 - DNA, 386 bp, Artificial Sequence; identical to SEQ ID NO: 1231
  Description of Artificial Sequence: Synthetic polynucleotide
  gi|Fabrus|D07_VH3-23_IGHD5-18*01(2)>3'_IGHJ1*01

SEQ ID NO: 1236 - DNA, 386 bp, Artificial Sequence
  Description of Artificial Sequence: Synthetic polynucleotide
  gi|Fabrus|D08_VH3-23_IGHD5-24*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctacgctgaatacttccagcactggggccaaggaaccctggtcaccgtctcctcagctagc

SEQ ID NO: 1237 - DNA, 386 bp, Artificial Sequence
  Description of Artificial Sequence: Synthetic polynucleotide
  gi|Fabrus|D09_VH3-23_IGHD5-24*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctacgctgaatacttccagcactggggccaaggaaccctggtcaccgtctcctcagctagc

SEQ ID NO: 1238 - DNA, 383 bp, Artificial Sequence
  Description of Artificial Sequence: Synthetic polynucleotide
  gi|Fabrus|D10_VH3-23_IGHD6-6*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctacgctgaatacttccagcactggggccaaggaaccctggtcaccgtctcctcagctagc

SEQ ID NO: 1239 - DNA, 383 bp, Artificial Sequence
  Description of Artificial Sequence: Synthetic polynucleotide
  gi|Fabrus|D11_VH3-23_IGHD6-6*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctacgctgaatacttccagcactggggccaaggaaccctggtcaccgtctcctcagctagc

SEQ ID NO: 1240 - DNA, 383 bp, Artificial Sequence
  Description of Artificial Sequence: Synthetic polynucleotide
  gi|Fabrus|D12_VH3-23_IGHD6-6*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctacgctgaatacttccagcactggggccaaggaaccctggtcaccgtctcctcagctagc

SEQ ID NO: 1241 - DNA, 386 bp, Artificial Sequence
  Description of Artificial Sequence: Synthetic polynucleotide
  gi|Fabrus|E01_VH3-23_IGHD6-13*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctacgctgaatacttccagcactggggccaaggaaccctggtcaccgtctcctcagctagc

SEQ ID NO: 1242 - DNA, 386 bp, Artificial Sequence
  Description of Artificial Sequence: Synthetic polynucleotide
  gi|Fabrus|E02_VH3-23_IGHD6-13*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctacgctgaatacttccagcactggggccaaggaaccctggtcaccgtctcctcagctagc

SEQ ID NO: 1243 - DNA, 386 bp, Artificial Sequence
  Description of Artificial Sequence: Synthetic polynucleotide
  gi|Fabrus|E03_VH3-23_IGHD6-13*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctacgctgaatacttccagcactggggccaaggaaccctggtcaccgtctcctcagctagc

SEQ ID NO: 1244 - DNA, 386 bp, Artificial Sequence
  Description of Artificial Sequence: Synthetic polynucleotide
  gi|Fabrus|E04_VH3-23_IGHD6-19*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctacgctgaatacttccagcactggggccaaggaaccctggtcaccgtctcctcagctagc

SEQ ID NO: 1245 - DNA, 386 bp, Artificial Sequence
  Description of Artificial Sequence: Synthetic polynucleotide
  gi|Fabrus|E05_VH3-23_IGHD6-19*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctacgctgaatacttccagcactggggccaaggaaccctggtcaccgtctcctcagctagc

SEQ ID NO: 1246 - DNA, 386 bp, Artificial Sequence
  Description of Artificial Sequence: Synthetic polynucleotide
  gi|Fabrus|E06_VH3-23_IGHD6-19*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctacgctgaatacttccagcactggggccaaggaaccctggtcaccgtctcctcagctagc

SEQ ID NO: 1247 - DNA, 383 bp, Artificial Sequence
  Description of Artificial Sequence: Synthetic polynucleotide
  gi|Fabrus|E07_VH3-23_IGHD6-25*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctacgctgaatacttccagcactggggccaaggaaccctggtcaccgtctcctcagctagc

SEQ ID NO: 1248 - DNA, 383 bp, Artificial Sequence
  Description of Artificial Sequence: Synthetic polynucleotide
  gi|Fabrus|E08_VH3-23_IGHD6-25*01>3'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctacgctgaatacttccagcactggggccaaggaaccctggtcaccgtctcctcagctagc

SEQ ID NO: 1249 - DNA, 377 bp, Artificial Sequence
  Description of Artificial Sequence: Synthetic polynucleotide
  gi|Fabrus|E09_VH3-23_IGHD7-27*01>1'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctacgctgaatacttccagcactggggccaaggaaccctggtcaccgtctcctcagctagc

SEQ ID NO: 1250 - DNA, 377 bp, Artificial Sequence
  Description of Artificial Sequence: Synthetic polynucleotide
  gi|Fabrus|E10_VH3-23_IGHD7-27*01>2'_IGHJ1*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctacgctgaatacttccagcactggggccaaggaaccctggtcaccgtctcctcagctagc

SEQ ID NO: 1251 - DNA, 383 bp, Artificial Sequence
  Description of Artificial Sequence: Synthetic polynucleotide
  gi|Fabrus|A01_VH3-23_IGHD1-1*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctactactggtacttcgattcctggggccaaggaaccctggtcaccgtctcctcagctagc

SEQ ID NO: 1252 - DNA, 383 bp, Artificial Sequence
  Description of Artificial Sequence: Synthetic polynucleotide
  gi|Fabrus|A02_VH3-23_IGHD1-1*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctactactggtacttcgattcctggggccaaggaaccctggtcaccgtctcctcagctagc

SEQ ID NO: 1253 - DNA, 383 bp, Artificial Sequence
  Description of Artificial Sequence: Synthetic polynucleotide
  gi|Fabrus|A03_VH3-23_IGHD1-1*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctactactggtacttcgattcctggggccaaggaaccctggtcaccgtctcctcagctagc

SEQ ID NO: 1254 - DNA, 383 bp, Artificial Sequence
  Description of Artificial Sequence: Synthetic polynucleotide
  gi|Fabrus|A04_VH3-23_IGHD1-7*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctactactggtacttcgattcctggggccaaggaaccctggtcaccgtctcctcagctagc

SEQ ID NO: 1255 - DNA, 383 bp, Artificial Sequence
  Description of Artificial Sequence: Synthetic polynucleotide
  gi|Fabrus|A05_VH3-23_IGHD1-7*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctactactggtacttcgattcctggggccaaggaaccctggtcaccgtctcctcagctagc

SEQ ID NO: 1256 - DNA, 383 bp, Artificial Sequence
  Description of Artificial Sequence: Synthetic polynucleotide
  gi|Fabrus|A06_VH3-23_IGHD1-14*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctactactggtacttcgattcctggggccaaggaaccctggtcaccgtctcctcagctagc

SEQ ID NO: 1257 - DNA, 383 bp, Artificial Sequence
  Description of Artificial Sequence: Synthetic polynucleotide
  gi|Fabrus|A07_VH3-23_IGHD1-14*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctactactggtacttcgattcctggggccaaggaaccctggtcaccgtctcctcagctagc

SEQ ID NO: 1258 - DNA, 383 bp, Artificial Sequence
  Description of Artificial Sequence: Synthetic polynucleotide
  gi|Fabrus|A08_VH3-23_IGHD1-20*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctactactggtacttcgattcctggggccaaggaaccctggtcaccgtctcctcagctagc

SEQ ID NO: 1259 - DNA, 383 bp, Artificial Sequence
  Description of Artificial Sequence: Synthetic polynucleotide
  gi|Fabrus|A09_VH3-23_IGHD1-20*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctactactggtacttcgattcctggggccaaggaaccctggtcaccgtctcctcagctagc

SEQ ID NO: 1260 - DNA, 386 bp, Artificial Sequence
  Description of Artificial Sequence: Synthetic polynucleotide
  gi|Fabrus|A10_VH3-23_IGHD1-26*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctactactggtacttcgattcctggggccaaggaaccctggtcaccgtctcctcagctagc

SEQ ID NO: 1261 - DNA, 386 bp, Artificial Sequence
  Description of Artificial Sequence: Synthetic polynucleotide
  gi|Fabrus|A11_VH3-23_IGHD1-26*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctactactggtacttcgattcctggggccaaggaaccctggtcaccgtctcctcagctagc

SEQ ID NO: 1262 - DNA, 395 bp, Artificial Sequence
  Description of Artificial Sequence: Synthetic polynucleotide
  gi|Fabrus|A12_VH3-23_IGHD2-2*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctactactggtacttcgattcctggggccaaggaaccctggtcaccgtctcctcagctagc

SEQ ID NO: 1263 - DNA, 395 bp, Artificial Sequence
  Description of Artificial Sequence: Synthetic polynucleotide
  gi|Fabrus|B01_VH3-23_IGHD2-2*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctactactggtacttcgattcctggggccaaggaaccctggtcaccgtctcctcagctagc

SEQ ID NO: 1264 - DNA, 395 bp, Artificial Sequence
  Description of Artificial Sequence: Synthetic polynucleotide
  gi|Fabrus|B02_VH3-23_IGHD2-8*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctactactggtacttcgattcctggggccaaggaaccctggtcaccgtctcctcagctagc

SEQ ID NO: 1265 - DNA, 395 bp, Artificial Sequence
  Description of Artificial Sequence: Synthetic polynucleotide
  gi|Fabrus|B03_VH3-23_IGHD2-8*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctactactggtacttcgattcctggggccaaggaaccctggtcaccgtctcctcagctagc

SEQ ID NO: 1266 - DNA, 395 bp, Artificial Sequence
  Description of Artificial Sequence: Synthetic polynucleotide
  gi|Fabrus|B04_VH3-23_IGHD2-15*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctactactggtacttcgattcctggggccaaggaaccctggtcaccgtctcctcagctagc

SEQ ID NO: 1267 - DNA, 395 bp, Artificial Sequence
  Description of Artificial Sequence: Synthetic polynucleotide
  gi|Fabrus|B05_VH3-23_IGHD2-15*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctactactggtacttcgattcctggggccaaggaaccctggtcaccgtctcctcagctagc

SEQ ID NO: 1268 - DNA, 392 bp, Artificial Sequence
  Description of Artificial Sequence: Synthetic polynucleotide
  gi|Fabrus|B06_VH3-23_IGHD2-21*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctactactggtacttcgattcctggggccaaggaaccctggtcaccgtctcctcagctagc

SEQ ID NO: 1269 - DNA, 392 bp, Artificial Sequence
  Description of Artificial Sequence: Synthetic polynucleotide
  gi|Fabrus|B07_VH3-23_IGHD2-21*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctactactggtacttcgattcctggggccaaggaaccctggtcaccgtctcctcagctagc

SEQ ID NO: 1270 - DNA, 395 bp, Artificial Sequence
  Description of Artificial Sequence: Synthetic polynucleotide
  gi|Fabrus|B08_VH3-23_IGHD3-3*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctactactggtacttcgattcctggggccaaggaaccctggtcaccgtctcctcagctagc

SEQ ID NO: 1271 - DNA, 395 bp, Artificial Sequence
  Description of Artificial Sequence: Synthetic polynucleotide
  gi|Fabrus|B09_VH3-23_IGHD3-3*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctactactggtacttcgattcctggggccaaggaaccctggtcaccgtctcctcagctagc

SEQ ID NO: 1272 - DNA, 395 bp, Artificial Sequence
  Description of Artificial Sequence: Synthetic polynucleotide
  gi|Fabrus|B10_VH3-23_IGHD3-3*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctactactggtacttcgattcctggggccaaggaaccctggtcaccgtctcctcagctagc

SEQ ID NO: 1273 - DNA, 395 bp, Artificial Sequence
  Description of Artificial Sequence: Synthetic polynucleotide
  gi|Fabrus|B11_VH3-23_IGHD3-9*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctactactggtacttcgattcctggggccaaggaaccctggtcaccgtctcctcagctagc

SEQ ID NO: 1274 - DNA, 395 bp, Artificial Sequence
  Description of Artificial Sequence: Synthetic polynucleotide
  gi|Fabrus|B12_VH3-23_IGHD3-10*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctactactggtacttcgattcctggggccaaggaaccctggtcaccgtctcctcagctagc

SEQ ID NO: 1275 - DNA, 395 bp, Artificial Sequence
  Description of Artificial Sequence: Synthetic polynucleotide
  gi|Fabrus|C01_VH3-23_IGHD3-10*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctactactggtacttcgattcctggggccaaggaaccctggtcaccgtctcctcagctagc

SEQ ID NO: 1276 - DNA, 401 bp, Artificial Sequence
  Description of Artificial Sequence: Synthetic polynucleotide
  gi|Fabrus|C02_VH3-23_IGHD3-16*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctactactggtacttcgattcctggggccaaggaaccctggtcaccgtctcctcagctagc

SEQ ID NO: 1277 - DNA, 401 bp, Artificial Sequence
  Description of Artificial Sequence: Synthetic polynucleotide
  gi|Fabrus|C03_VH3-23_IGHD3-16*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctactactggtacttcgattcctggggccaaggaaccctggtcaccgtctcctcagctagc

SEQ ID NO: 1278 - DNA, 395 bp, Artificial Sequence
  Description of Artificial Sequence: Synthetic polynucleotide
  gi|Fabrus|C04_VH3-23_IGHD3-22*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctactactggtacttcgattcctggggccaaggaaccctggtcaccgtctcctcagctagc

SEQ ID NO: 1279 - DNA, 395 bp, Artificial Sequence
  Description of Artificial Sequence: Synthetic polynucleotide
  gi|Fabrus|C05_VH3-23_IGHD3-22*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctactactggtacttcgattcctggggccaaggaaccctggtcaccgtctcctcagctagc

SEQ ID NO: 1280 - DNA, 380 bp, Artificial Sequence
  Description of Artificial Sequence: Synthetic polynucleotide
  gi|Fabrus|C06_VH3-23_IGHD4-4*01(1)>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctactactggtacttcgattcctggggccaaggaaccctggtcaccgtctcctcagctagc

SEQ ID NO: 1281 - DNA, 380 bp, Artificial Sequence
  Description of Artificial Sequence: Synthetic polynucleotide
  gi|Fabrus|C07_VH3-23_IGHD4-4*01(1)>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctactactggtacttcgattcctggggccaaggaaccctggtcaccgtctcctcagctagc

SEQ ID NO: 1282 - DNA, 380 bp, Artificial Sequence; identical to SEQ ID NO: 1280
  Description of Artificial Sequence: Synthetic polynucleotide
  gi|Fabrus|C08_VH3-23_IGHD4-11*01(1)>2_IGHJ2*01

SEQ ID NO: 1283 - DNA, 380 bp, Artificial Sequence; identical to SEQ ID NO: 1281
  Description of Artificial Sequence: Synthetic polynucleotide
  gi|Fabrus|C09_VH3-23_IGHD4-11*01(1)>3_IGHJ2*01

SEQ ID NO: 1284 - DNA, 380 bp, Artificial Sequence
  Description of Artificial Sequence: Synthetic polynucleotide
  gi|Fabrus|C10_VH3-23_IGHD4-17*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctactactggtacttcgattcctggggccaaggaaccctggtcaccgtctcctcagctagc

SEQ ID NO: 1285 - DNA, 380 bp, Artificial Sequence
  Description of Artificial Sequence: Synthetic polynucleotide
  gi|Fabrus|C11_VH3-23_IGHD4-17*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctactactggtacttcgattcctggggccaaggaaccctggtcaccgtctcctcagctagc

SEQ ID NO: 1286 - DNA, 383 bp, Artificial Sequence
  Description of Artificial Sequence: Synthetic polynucleotide
  gi|Fabrus|C12_VH3-23_IGHD4-23*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctactactggtacttcgattcctggggccaaggaaccctggtcaccgtctcctcagctagc

SEQ ID NO: 1287 - DNA, 383 bp, Artificial Sequence
  Description of Artificial Sequence: Synthetic polynucleotide
  gi|Fabrus|D01_VH3-23_IGHD4-23*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctactactggtacttcgattcctggggccaaggaaccctggtcaccgtctcctcagctagc

SEQ ID NO: 1288 - DNA, 386 bp, Artificial Sequence
  Description of Artificial Sequence: Synthetic polynucleotide
  gi|Fabrus|D02_VH3-23_IGHD5-5*01(2)>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctactactggtacttcgattcctggggccaaggaaccctggtcaccgtctcctcagctagc

SEQ ID NO: 1289 - DNA, 386 bp, Artificial Sequence
  Description of Artificial Sequence: Synthetic polynucleotide
  gi|Fabrus|D03_VH3-23_IGHD5-5*01(2)>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctactactggtacttcgattcctggggccaaggaaccctggtcaccgtctcctcagctagc

SEQ ID NO: 1290 - DNA, 386 bp, Artificial Sequence
  Description of Artificial Sequence: Synthetic polynucleotide
  gi|Fabrus|D04_VH3-23_IGHD5-5*01(2)>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctactactggtacttcgattcctggggccaaggaaccctggtcaccgtctcctcagctagc

SEQ ID NO: 1291 - DNA, 389 bp, Artificial Sequence
  Description of Artificial Sequence: Synthetic polynucleotide
  gi|Fabrus|D05_VH3-23_IGHD5-12*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctactactggtacttcgattcctggggccaaggaaccctggtcaccgtctcctcagctagc

SEQ ID NO: 1292 - DNA, 389 bp, Artificial Sequence
  Description of Artificial Sequence: Synthetic polynucleotide
  gi|Fabrus|D06_VH3-23_IGHD5-12*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctactactggtacttcgattcctggggccaaggaaccctggtcaccgtctcctcagctagc

SEQ ID NO: 1293 - DNA, 386 bp, Artificial Sequence; identical to SEQ ID NO: 1288
  Description of Artificial Sequence: Synthetic polynucleotide
  gi|Fabrus|D07_VH3-23_IGHD5-18*01(2)>1_IGHJ2*01

SEQ ID NO: 1294 - DNA, 386 bp, Artificial Sequence; identical to SEQ ID NO: 1289
  Description of Artificial Sequence: Synthetic polynucleotide
  gi|Fabrus|D08_VH3-23_IGHD5-18*01(2)>2_IGHJ2*01

SEQ ID NO: 1295 - DNA, 386 bp, Artificial Sequence; identical to SEQ ID NO: 1290
  Description of Artificial Sequence: Synthetic polynucleotide
  gi|Fabrus|D09_VH3-23_IGHD5-18*01(2)>3_IGHJ2*01

SEQ ID NO: 1296 - DNA, 386 bp, Artificial Sequence
  Description of Artificial Sequence: Synthetic polynucleotide
  gi|Fabrus|D10_VH3-23_IGHD5-24*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctactactggtacttcgattcctggggccaaggaaccctggtcaccgtctcctcagctagc

SEQ ID NO: 1297 - DNA, 386 bp, Artificial Sequence
  Description of Artificial Sequence: Synthetic polynucleotide
  gi|Fabrus|D11_VH3-23_IGHD5-24*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctactactggtacttcgattcctggggccaaggaaccctggtcaccgtctcctcagctagc

SEQ ID NO: 1298 - DNA, 383 bp, Artificial Sequence
  Description of Artificial Sequence: Synthetic polynucleotide
  gi|Fabrus|D12_VH3-23_IGHD6-6*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctactactggtacttcgattcctggggccaaggaaccctggtcaccgtctcctcagctagc

SEQ ID NO: 1299 - DNA, 383 bp, Artificial Sequence
  Description of Artificial Sequence: Synthetic polynucleotide
  gi|Fabrus|E01_VH3-23_IGHD6-6*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctactactggtacttcgattcctggggccaaggaaccctggtcaccgtctcctcagctagc

SEQ ID NO: 1300 - DNA, 386 bp, Artificial Sequence
  Description of Artificial Sequence: Synthetic polynucleotide
  gi|Fabrus|E02_VH3-23_IGHD6-13*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctactactggtacttcgattcctggggccaaggaaccctggtcaccgtctcctcagctagc

SEQ ID NO: 1301 - DNA, 386 bp, Artificial Sequence
  Description of Artificial Sequence: Synthetic polynucleotide
  gi|Fabrus|E03_VH3-23_IGHD6-13*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctactactggtacttcgattcctggggccaaggaaccctggtcaccgtctcctcagctagc

SEQ ID NO: 1302 - DNA, 386 bp, Artificial Sequence
  Description of Artificial Sequence: Synthetic polynucleotide
  gi|Fabrus|E04_VH3-23_IGHD6-19*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctactactggtacttcgattcctggggccaaggaaccctggtcaccgtctcctcagctagc

SEQ ID NO: 1303 - DNA, 386 bp, Artificial Sequence
  Description of Artificial Sequence: Synthetic polynucleotide
  gi|Fabrus|E05_VH3-23_IGHD6-19*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctactactggtacttcgattcctggggccaaggaaccctggtcaccgtctcctcagctagc

SEQ ID NO: 1304 - DNA, 383 bp, Artificial Sequence
  Description of Artificial Sequence: Synthetic polynucleotide
  gi|Fabrus|E06_VH3-23_IGHD6-25*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctactactggtacttcgattcctggggccaaggaaccctggtcaccgtctcctcagctagc

SEQ ID NO: 1305 - DNA, 383 bp, Artificial Sequence
  Description of Artificial Sequence: Synthetic polynucleotide
  gi|Fabrus|E07_VH3-23_IGHD6-25*01>2_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctactactggtacttcgattcctggggccaaggaaccctggtcaccgtctcctcagctagc

SEQ ID NO: 1306 - DNA, 377 bp, Artificial Sequence
  Description of Artificial Sequence: Synthetic polynucleotide
  gi|Fabrus|E08_VH3-23_IGHD7-27*01>1_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctactactggtacttcgattcctggggccaaggaaccctggtcaccgtctcctcagctagc

SEQ ID NO: 1307 - DNA, 377 bp, Artificial Sequence
  Description of Artificial Sequence: Synthetic polynucleotide
  gi|Fabrus|E09_VH3-23_IGHD7-27*01>3_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctactactggtacttcgattcctggggccaaggaaccctggtcaccgtctcctcagctagc

SEQ ID NO: 1308 - DNA, 383 bp, Artificial Sequence
  Description of Artificial Sequence: Synthetic polynucleotide
  gi|Fabrus|A01_VH3-23_IGHD1-1*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctactactggtacttcgattcctggggccaaggaaccctggtcaccgtctcctcagctagc

SEQ ID NO: 1309 - DNA, 383 bp, Artificial Sequence
  Description of Artificial Sequence: Synthetic polynucleotide
  gi|Fabrus|A02_VH3-23_IGHD1-1*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctactactggtacttcgattcctggggccaaggaaccctggtcaccgtctcctcagctagc

SEQ ID NO: 1310 - DNA, 383 bp, Artificial Sequence
  Description of Artificial Sequence: Synthetic polynucleotide
  gi|Fabrus|A03_VH3-23_IGHD1-1*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctactactggtacttcgattcctggggccaaggaaccctggtcaccgtctcctcagctagc

SEQ ID NO: 1311 - DNA, 383 bp, Artificial Sequence
  Description of Artificial Sequence: Synthetic polynucleotide
  gi|Fabrus|A04_VH3-23_IGHD1-7*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctactactggtacttcgattcctggggccaaggaaccctggtcaccgtctcctcagctagc

SEQ ID NO: 1312 - DNA, 383 bp, Artificial Sequence
  Description of Artificial Sequence: Synthetic polynucleotide
  gi|Fabrus|A05_VH3-23_IGHD1-7*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctactactggtacttcgattcctggggccaaggaaccctggtcaccgtctcctcagctagc

SEQ ID NO: 1313 - DNA, 383 bp, Artificial Sequence
  Description of Artificial Sequence: Synthetic polynucleotide
  gi|Fabrus|A06_VH3-23_IGHD1-14*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctactactggtacttcgattcctggggccaaggaaccctggtcaccgtctcctcagctagc

SEQ ID NO: 1314 - DNA, 383 bp, Artificial Sequence
  Description of Artificial Sequence: Synthetic polynucleotide
  gi|Fabrus|A07_VH3-23_IGHD1-14*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctactactggtacttcgattcctggggccaaggaaccctggtcaccgtctcctcagctagc

SEQ ID NO: 1315 - DNA, 383 bp, Artificial Sequence
  Description of Artificial Sequence: Synthetic polynucleotide
  gi|Fabrus|A08_VH3-23_IGHD1-14*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctactactggtacttcgattcctggggccaaggaaccctggtcaccgtctcctcagctagc

SEQ ID NO: 1316 - DNA, 383 bp, Artificial Sequence
  Description of Artificial Sequence: Synthetic polynucleotide
  gi|Fabrus|A09_VH3-23_IGHD1-20*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctactactggtacttcgattcctggggccaaggaaccctggtcaccgtctcctcagctagc

SEQ ID NO: 1317 - DNA, 383 bp, Artificial Sequence
  Description of Artificial Sequence: Synthetic polynucleotide
  gi|Fabrus|A10_VH3-23_IGHD1-20*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctactactggtacttcgattcctggggccaaggaaccctggtcaccgtctcctcagctagc

SEQ ID NO: 1318 - DNA, 383 bp, Artificial Sequence
  Description of Artificial Sequence: Synthetic polynucleotide
  gi|Fabrus|A11_VH3-23_IGHD1-20*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctactactggtacttcgattcctggggccaaggaaccctggtcaccgtctcctcagctagc

SEQ ID NO: 1319 - DNA, 386 bp, Artificial Sequence
  Description of Artificial Sequence: Synthetic polynucleotide
  gi|Fabrus|A12_VH3-23_IGHD1-26*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctactactggtacttcgattcctggggccaaggaaccctggtcaccgtctcctcagctagc

SEQ ID NO: 1320 - DNA, 386 bp, Artificial Sequence
  Description of Artificial Sequence: Synthetic polynucleotide
  gi|Fabrus|B01_VH3-23_IGHD1-26*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctactactggtacttcgattcctggggccaaggaaccctggtcaccgtctcctcagctagc

SEQ ID NO: 1321 - DNA, 395 bp, Artificial Sequence
  Description of Artificial Sequence: Synthetic polynucleotide
  gi|Fabrus|B02_VH3-23_IGHD2-2*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctactactggtacttcgattcctggggccaaggaaccctggtcaccgtctcctcagctagc

SEQ ID NO: 1322 - DNA, 395 bp, Artificial Sequence
  Description of Artificial Sequence: Synthetic polynucleotide
  gi|Fabrus|B03_VH3-23_IGHD2-2*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctactactggtacttcgattcctggggccaaggaaccctggtcaccgtctcctcagctagc

SEQ ID NO: 1323 - DNA, 395 bp, Artificial Sequence
  Description of Artificial Sequence: Synthetic polynucleotide
  gi|Fabrus|B04_VH3-23_IGHD2-8*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctactactggtacttcgattcctggggccaaggaaccctggtcaccgtctcctcagctagc

SEQ ID NO: 1324 - DNA, 395 bp, Artificial Sequence
  Description of Artificial Sequence: Synthetic polynucleotide
  gi|Fabrus|B05_VH3-23_IGHD2-15*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctactactggtacttcgattcctggggccaaggaaccctggtcaccgtctcctcagctagc

SEQ ID NO: 1325 - DNA, 395 bp, Artificial Sequence
  Description of Artificial Sequence: Synthetic polynucleotide
  gi|Fabrus|B06_VH3-23_IGHD2-15*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctactactggtacttcgattcctggggccaaggaaccctggtcaccgtctcctcagctagc

SEQ ID NO: 1326 - DNA, 392 bp, Artificial Sequence
  Description of Artificial Sequence: Synthetic polynucleotide
  gi|Fabrus|B07_VH3-23_IGHD2-21*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctactactggtacttcgattcctggggccaaggaaccctggtcaccgtctcctcagctagc

SEQ ID NO: 1327 - DNA, 392 bp, Artificial Sequence
  Description of Artificial Sequence: Synthetic polynucleotide
  gi|Fabrus|B08_VH3-23_IGHD2-21*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctactactggtacttcgattcctggggccaaggaaccctggtcaccgtctcctcagctagc

SEQ ID NO: 1328 - DNA, 395 bp, Artificial Sequence
  Description of Artificial Sequence: Synthetic polynucleotide
  gi|Fabrus|B09_VH3-23_IGHD3-3*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctactactggtacttcgattcctggggccaaggaaccctggtcaccgtctcctcagctagc

SEQ ID NO: 1329 - DNA, 395 bp, Artificial Sequence
  Description of Artificial Sequence: Synthetic polynucleotide
  gi|Fabrus|B10_VH3-23_IGHD3-3*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctactactggtacttcgattcctggggccaaggaaccctggtcaccgtctcctcagctagc

SEQ ID NO: 1330 - DNA, 395 bp, Artificial Sequence
  Description of Artificial Sequence: Synthetic polynucleotide
  gi|Fabrus|B11_VH3-23_IGHD3-9*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctactactggtacttcgattcctggggccaaggaaccctggtcaccgtctcctcagctagc

SEQ ID NO: 1331 - DNA, 395 bp, Artificial Sequence
  Description of Artificial Sequence: Synthetic polynucleotide
  gi|Fabrus|B12_VH3-23_IGHD3-9*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctactactggtacttcgattcctggggccaaggaaccctggtcaccgtctcctcagctagc

SEQ ID NO: 1332 - DNA, 395 bp, Artificial Sequence
  Description of Artificial Sequence: Synthetic polynucleotide
  gi|Fabrus|C01_VH3-23_IGHD3-10*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctactactggtacttcgattcctggggccaaggaaccctggtcaccgtctcctcagctagc

SEQ ID NO: 1333 - DNA, 395 bp, Artificial Sequence
  Description of Artificial Sequence: Synthetic polynucleotide
  gi|Fabrus|C02_VH3-23_IGHD3-10*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctactactggtacttcgattcctggggccaaggaaccctggtcaccgtctcctcagctagc

SEQ ID NO: 1334 - DNA, 401 bp, Artificial Sequence
  Description of Artificial Sequence: Synthetic polynucleotide
  gi|Fabrus|C03_VH3-23_IGHD3-16*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctactactggtacttcgattcctggggccaaggaaccctggtcaccgtctcctcagctagc

SEQ ID NO: 1335 - DNA, 401 bp, Artificial Sequence
  Description of Artificial Sequence: Synthetic polynucleotide
  gi|Fabrus|C04_VH3-23_IGHD3-16*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctactactggtacttcgattcctggggccaaggaaccctggtcaccgtctcctcagctagc

SEQ ID NO: 1336 - DNA, 395 bp, Artificial Sequence
  Description of Artificial Sequence: Synthetic polynucleotide
  gi|Fabrus|C05_VH3-23_IGHD3-22*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctactactggtacttcgattcctggggccaaggaaccctggtcaccgtctcctcagctagc

SEQ ID NO: 1337 - DNA, 380 bp, Artificial Sequence
  Description of Artificial Sequence: Synthetic polynucleotide
  gi|Fabrus|C06_VH3-23_IGHD4-4*01(1)>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctactactggtacttcgattcctggggccaaggaaccctggtcaccgtctcctcagctagc

SEQ ID NO: 1338 - DNA, 380 bp, Artificial Sequence
  Description of Artificial Sequence: Synthetic polynucleotide
  gi|Fabrus|C07_VH3-23_IGHD4-4*01(1)>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctactactggtacttcgattcctggggccaaggaaccctggtcaccgtctcctcagctagc

SEQ ID NO: 1339 - DNA, 380 bp, Artificial Sequence; identical to SEQ ID NO: 1337
  Description of Artificial Sequence: Synthetic polynucleotide
  gi|Fabrus|C08_VH3-23_IGHD4-11*01(1)>1'_IGHJ2*01

SEQ ID NO: 1340 - DNA, 380 bp, Artificial Sequence; identical to SEQ ID NO: 1338
  Description of Artificial Sequence: Synthetic polynucleotide
  gi|Fabrus|C09_VH3-23_IGHD4-11*01(1)>3'_IGHJ2*01

SEQ ID NO: 1341 - DNA, 380 bp, Artificial Sequence
  Description of Artificial Sequence: Synthetic polynucleotide
  gi|Fabrus|C10_VH3-23_IGHD4-17*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctactactggtacttcgattcctggggccaaggaaccctggtcaccgtctcctcagctagc

SEQ ID NO: 1342 - DNA, 380 bp, Artificial Sequence
  Description of Artificial Sequence: Synthetic polynucleotide
  gi|Fabrus|C11_VH3-23_IGHD4-17*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctactactggtacttcgattcctggggccaaggaaccctggtcaccgtctcctcagctagc

SEQ ID NO: 1343 - DNA, 383 bp, Artificial Sequence
  Description of Artificial Sequence: Synthetic polynucleotide
  gi|Fabrus|C12_VH3-23_IGHD4-23*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctactactggtacttcgattcctggggccaaggaaccctggtcaccgtctcctcagctagc

SEQ ID NO: 1344 - DNA, 383 bp, Artificial Sequence
  Description of Artificial Sequence: Synthetic polynucleotide
  gi|Fabrus|D01_VH3-23_IGHD4-23*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctactactggtacttcgattcctggggccaaggaaccctggtcaccgtctcctcagctagc

SEQ ID NO: 1345 - DNA, 386 bp, Artificial Sequence
  Description of Artificial Sequence: Synthetic polynucleotide
  gi|Fabrus|D02_VH3-23_IGHD5-5*01(2)>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctactactggtacttcgattcctggggccaaggaaccctggtcaccgtctcctcagctagc

SEQ ID NO: 1346 - DNA, 386 bp, Artificial Sequence
  Description of Artificial Sequence: Synthetic polynucleotide
  gi|Fabrus|D03_VH3-23_IGHD5-5*01(2)>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctactactggtacttcgattcctggggccaaggaaccctggtcaccgtctcctcagctagc

SEQ ID NO: 1347 - DNA, 389 bp, Artificial Sequence
  Description of Artificial Sequence: Synthetic polynucleotide
  gi|Fabrus|D04_VH3-23_IGHD5-12*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctactactggtacttcgattcctggggccaaggaaccctggtcaccgtctcctcagctagc

SEQ ID NO: 1348 - DNA, 389 bp, Artificial Sequence
  Description of Artificial Sequence: Synthetic polynucleotide
  gi|Fabrus|D05_VH3-23_IGHD5-12*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctactactggtacttcgattcctggggccaaggaaccctggtcaccgtctcctcagctagc

SEQ ID NO: 1349 - DNA, 386 bp, Artificial Sequence; identical to SEQ ID NO: 1345
  Description of Artificial Sequence: Synthetic polynucleotide
  gi|Fabrus|D06_VH3-23_IGHD5-18*01(2)>1'_IGHJ2*01

SEQ ID NO: 1350 - DNA, 386 bp, Artificial Sequence; identical to SEQ ID NO: 1346
  Description of Artificial Sequence: Synthetic polynucleotide
  gi|Fabrus|D07_VH3-23_IGHD5-18*01(2)>3'_IGHJ2*01

SEQ ID NO: 1351 - DNA, 386 bp, Artificial Sequence
  Description of Artificial Sequence: Synthetic polynucleotide
  gi|Fabrus|D08_VH3-23_IGHD5-24*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctactactggtacttcgattcctggggccaaggaaccctggtcaccgtctcctcagctagc

SEQ ID NO: 1352 - DNA, 386 bp, Artificial Sequence
  Description of Artificial Sequence: Synthetic polynucleotide
  gi|Fabrus|D09_VH3-23_IGHD5-24*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctactactggtacttcgattcctggggccaaggaaccctggtcaccgtctcctcagctagc

SEQ ID NO: 1353 - DNA, 383 bp, Artificial Sequence
  Description of Artificial Sequence: Synthetic polynucleotide
  gi|Fabrus|D10_VH3-23_IGHD6-6*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctactactggtacttcgattcctggggccaaggaaccctggtcaccgtctcctcagctagc

SEQ ID NO: 1354 - DNA, 383 bp, Artificial Sequence
  Description of Artificial Sequence: Synthetic polynucleotide
  gi|Fabrus|D11_VH3-23_IGHD6-6*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctactactggtacttcgattcctggggccaaggaaccctggtcaccgtctcctcagctagc

SEQ ID NO: 1355 - DNA, 383 bp, Artificial Sequence
  Description of Artificial Sequence: Synthetic polynucleotide
  gi|Fabrus|D12_VH3-23_IGHD6-6*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctactactggtacttcgattcctggggccaaggaaccctggtcaccgtctcctcagctagc

SEQ ID NO: 1356 - DNA, 386 bp, Artificial Sequence
  Description of Artificial Sequence: Synthetic polynucleotide
  gi|Fabrus|E01_VH3-23_IGHD6-13*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctactactggtacttcgattcctggggccaaggaaccctggtcaccgtctcctcagctagc

SEQ ID NO: 1357 - DNA, 386 bp, Artificial Sequence
  Description of Artificial Sequence: Synthetic polynucleotide
  gi|Fabrus|E02_VH3-23_IGHD6-13*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctactactggtacttcgattcctggggccaaggaaccctggtcaccgtctcctcagctagc

SEQ ID NO: 1358 - DNA, 386 bp, Artificial Sequence
  Description of Artificial Sequence: Synthetic polynucleotide
  gi|Fabrus|E03_VH3-23_IGHD6-13*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctactactggtacttcgattcctggggccaaggaaccctggtcaccgtctcctcagctagc

SEQ ID NO: 1359 - DNA, 386 bp, Artificial Sequence
  Description of Artificial Sequence: Synthetic polynucleotide
  gi|Fabrus|E04_VH3-23_IGHD6-19*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctactactggtacttcgattcctggggccaaggaaccctggtcaccgtctcctcagctagc

SEQ ID NO: 1360 - DNA, 386 bp, Artificial Sequence
  Description of Artificial Sequence: Synthetic polynucleotide
  gi|Fabrus|E05_VH3-23_IGHD6-19*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctactactggtacttcgattcctggggccaaggaaccctggtcaccgtctcctcagctagc

SEQ ID NO: 1361 - DNA, 386 bp, Artificial Sequence
  Description of Artificial Sequence: Synthetic polynucleotide
  gi|Fabrus|E06_VH3-23_IGHD6-19*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctactactggtacttcgattcctggggccaaggaaccctggtcaccgtctcctcagctagc

SEQ ID NO: 1362 - DNA, 383 bp, Artificial Sequence
  Description of Artificial Sequence: Synthetic polynucleotide
  gi|Fabrus|E07_VH3-23_IGHD6-25*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctactactggtacttcgattcctggggccaaggaaccctggtcaccgtctcctcagctagc

SEQ ID NO: 1363 - DNA, 383 bp, Artificial Sequence
  Description of Artificial Sequence: Synthetic polynucleotide
  gi|Fabrus|E08_VH3-23_IGHD6-25*01>3'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctactactggtacttcgattcctggggccaaggaaccctggtcaccgtctcctcagctagc

SEQ ID NO: 1364 - DNA, 377 bp, Artificial Sequence
  Description of Artificial Sequence: Synthetic polynucleotide
  gi|Fabrus|E09_VH3-23_IGHD7-27*01>1'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctactactggtacttcgattcctggggccaaggaaccctggtcaccgtctcctcagctagc

SEQ ID NO: 1365 - DNA, 377 bp, Artificial Sequence
  Description of Artificial Sequence: Synthetic polynucleotide
  gi|Fabrus|E10_VH3-23_IGHD7-27*01>2'_IGHJ2*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctactactggtacttcgattcctggggccaaggaaccctggtcaccgtctcctcagctagc

SEQ ID NO: 1366 - DNA, 377 bp, Artificial Sequence
  Description of Artificial Sequence: Synthetic polynucleotide
  gi|Fabrus|A01_VH3-23_IGHD1-1*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctatgcttttgatgtctggggccaaggaaccctggtcaccgtctcctcagctagc

SEQ ID NO: 1367 - DNA, 377 bp, Artificial Sequence
  Description of Artificial Sequence: Synthetic polynucleotide
  gi|Fabrus|A02_VH3-23_IGHD1-1*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctatgcttttgatgtctggggccaaggaaccctggtcaccgtctcctcagctagc

SEQ ID NO: 1368 - DNA, 377 bp, Artificial Sequence
  Description of Artificial Sequence: Synthetic polynucleotide
  gi|Fabrus|A03_VH3-23_IGHD1-1*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctatgcttttgatgtctggggccaaggaaccctggtcaccgtctcctcagctagc

SEQ ID NO: 1369 - DNA, 377 bp, Artificial Sequence
  Description of Artificial Sequence: Synthetic polynucleotide
  gi|Fabrus|A04_VH3-23_IGHD1-7*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctatgcttttgatgtctggggccaaggaaccctggtcaccgtctcctcagctagc

SEQ ID NO: 1370 - DNA, 377 bp, Artificial Sequence
  Description of Artificial Sequence: Synthetic polynucleotide
  gi|Fabrus|A05_VH3-23_IGHD1-7*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctatgcttttgatgtctggggccaaggaaccctggtcaccgtctcctcagctagc

SEQ ID NO: 1371 - DNA, 377 bp, Artificial Sequence
  Description of Artificial Sequence: Synthetic polynucleotide
  gi|Fabrus|A06_VH3-23_IGHD1-14*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctatgcttttgatgtctggggccaaggaaccctggtcaccgtctcctcagctagc

SEQ ID NO: 1372 - DNA, 377 bp, Artificial Sequence
  Description of Artificial Sequence: Synthetic polynucleotide
  gi|Fabrus|A07_VH3-23_IGHD1-14*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctatgcttttgatgtctggggccaaggaaccctggtcaccgtctcctcagctagc

SEQ ID NO: 1373 - DNA, 377 bp, Artificial Sequence
  Description of Artificial Sequence: Synthetic polynucleotide
  gi|Fabrus|A08_VH3-23_IGHD1-20*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctatgcttttgatgtctggggccaaggaaccctggtcaccgtctcctcagctagc

SEQ ID NO: 1374 - DNA, 377 bp, Artificial Sequence
  Description of Artificial Sequence: Synthetic polynucleotide
  gi|Fabrus|A09_VH3-23_IGHD1-20*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctatgcttttgatgtctggggccaaggaaccctggtcaccgtctcctcagctagc

SEQ ID NO: 1375 - DNA, 380 bp, Artificial Sequence
  Description of Artificial Sequence: Synthetic polynucleotide
  gi|Fabrus|A10_VH3-23_IGHD1-26*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctatgcttttgatgtctggggccaaggaaccctggtcaccgtctcctcagctagc

SEQ ID NO: 1376 - DNA, 380 bp, Artificial Sequence
  Description of Artificial Sequence: Synthetic polynucleotide
  gi|Fabrus|A11_VH3-23_IGHD1-26*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctatgcttttgatgtctggggccaaggaaccctggtcaccgtctcctcagctagc

SEQ ID NO: 1377 - DNA, 389 bp, Artificial Sequence
  Description of Artificial Sequence: Synthetic polynucleotide
  gi|Fabrus|A12_VH3-23_IGHD2-2*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctatgcttttgatgtctggggccaaggaaccctggtcaccgtctcctcagctagc

SEQ ID NO: 1378 - DNA, 389 bp, Artificial Sequence
  Description of Artificial Sequence: Synthetic polynucleotide
  gi|Fabrus|B01_VH3-23_IGHD2-2*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctatgcttttgatgtctggggccaaggaaccctggtcaccgtctcctcagctagc

SEQ ID NO: 1379 - DNA, 389 bp, Artificial Sequence
  Description of Artificial Sequence: Synthetic polynucleotide
  gi|Fabrus|B02_VH3-23_IGHD2-8*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctatgcttttgatgtctggggccaaggaaccctggtcaccgtctcctcagctagc

SEQ ID NO: 1380 - DNA, 389 bp, Artificial Sequence
  Description of Artificial Sequence: Synthetic polynucleotide
  gi|Fabrus|B03_VH3-23_IGHD2-8*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctatgcttttgatgtctggggccaaggaaccctggtcaccgtctcctcagctagc

SEQ ID NO: 1381 - DNA, 389 bp, Artificial Sequence
  Description of Artificial Sequence: Synthetic polynucleotide
  gi|Fabrus|B04_VH3-23_IGHD2-15*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctatgcttttgatgtctggggccaaggaaccctggtcaccgtctcctcagctagc

SEQ ID NO: 1382 - DNA, 389 bp, Artificial Sequence
  Description of Artificial Sequence: Synthetic polynucleotide
  gi|Fabrus|B05_VH3-23_IGHD2-15*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctatgcttttgatgtctggggccaaggaaccctggtcaccgtctcctcagctagc

SEQ ID NO: 1383 - DNA, 386 bp, Artificial Sequence
  Description of Artificial Sequence: Synthetic polynucleotide
  gi|Fabrus|B06_VH3-23_IGHD2-21*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctatgcttttgatgtctggggccaaggaaccctggtcaccgtctcctcagctagc

SEQ ID NO: 1384 - DNA, 386 bp, Artificial Sequence
  Description of Artificial Sequence: Synthetic polynucleotide
  gi|Fabrus|B07_VH3-23_IGHD2-21*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctatgcttttgatgtctggggccaaggaaccctggtcaccgtctcctcagctagc

SEQ ID NO: 1385 - DNA, 389 bp, Artificial Sequence
  Description of Artificial Sequence: Synthetic polynucleotide
  gi|Fabrus|B08_VH3-23_IGHD3-3*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctatgcttttgatgtctggggccaaggaaccctggtcaccgtctcctcagctagc

SEQ ID NO: 1386 - DNA, 389 bp, Artificial Sequence
  Description of Artificial Sequence: Synthetic polynucleotide
  gi|Fabrus|B09_VH3-23_IGHD3-3*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctatgcttttgatgtctggggccaaggaaccctggtcaccgtctcctcagctagc

SEQ ID NO: 1387 - DNA, 389 bp, Artificial Sequence
  Description of Artificial Sequence: Synthetic polynucleotide
  gi|Fabrus|B10_VH3-23_IGHD3-3*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctatgcttttgatgtctggggccaaggaaccctggtcaccgtctcctcagctagc

SEQ ID NO: 1388 - DNA, 389 bp, Artificial Sequence
  Description of Artificial Sequence: Synthetic polynucleotide
  gi|Fabrus|B11_VH3-23_IGHD3-9*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctatgcttttgatgtctggggccaaggaaccctggtcaccgtctcctcagctagc

SEQ ID NO: 1389 - DNA, 389 bp, Artificial Sequence
  Description of Artificial Sequence: Synthetic polynucleotide
  gi|Fabrus|B12_VH3-23_IGHD3-10*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctatgcttttgatgtctggggccaaggaaccctggtcaccgtctcctcagctagc

SEQ ID NO: 1390 - DNA, 389 bp, Artificial Sequence
  Description of Artificial Sequence: Synthetic polynucleotide
  gi|Fabrus|C01_VH3-23_IGHD3-10*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctatgcttttgatgtctggggccaaggaaccctggtcaccgtctcctcagctagc

SEQ ID NO: 1391 - DNA, 395 bp, Artificial Sequence
  Description of Artificial Sequence: Synthetic polynucleotide
  gi|Fabrus|C02_VH3-23_IGHD3-16*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctatgcttttgatgtctggggccaaggaaccctggtcaccgtctcctcagctagc

SEQ ID NO: 1392 - DNA, 395 bp, Artificial Sequence
  Description of Artificial Sequence: Synthetic polynucleotide
  gi|Fabrus|C03_VH3-23_IGHD3-16*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctatgcttttgatgtctggggccaaggaaccctggtcaccgtctcctcagctagc

SEQ ID NO: 1393 - DNA, 389 bp, Artificial Sequence
  Description of Artificial Sequence: Synthetic polynucleotide
  gi|Fabrus|C04_VH3-23_IGHD3-22*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctatgcttttgatgtctggggccaaggaaccctggtcaccgtctcctcagctagc

SEQ ID NO: 1394 - DNA, 389 bp, Artificial Sequence
  Description of Artificial Sequence: Synthetic polynucleotide
  gi|Fabrus|C05_VH3-23_IGHD3-22*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctatgcttttgatgtctggggccaaggaaccctggtcaccgtctcctcagctagc

SEQ ID NO: 1395 - DNA, 374 bp, Artificial Sequence
  Description of Artificial Sequence: Synthetic polynucleotide
  gi|Fabrus|C06_VH3-23_IGHD4-4*01(1)>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctatgcttttgatgtctggggccaaggaaccctggtcaccgtctcctcagctagc

SEQ ID NO: 1396 - DNA, 374 bp, Artificial Sequence
  Description of Artificial Sequence: Synthetic polynucleotide
  gi|Fabrus|C07_VH3-23_IGHD4-4*01(1)>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctatgcttttgatgtctggggccaaggaaccctggtcaccgtctcctcagctagc

SEQ ID NO: 1397 - DNA, 374 bp, Artificial Sequence; identical to SEQ ID NO: 1395
  Description of Artificial Sequence: Synthetic polynucleotide
  gi|Fabrus|C08_VH3-23_IGHD4-11*01(1)>2_IGHJ3*01

SEQ ID NO: 1398 - DNA, 374 bp, Artificial Sequence; identical to SEQ ID NO: 1396
  Description of Artificial Sequence: Synthetic polynucleotide
  gi|Fabrus|C09_VH3-23_IGHD4-11*01(1)>3_IGHJ3*01

SEQ ID NO: 1399 - DNA, 374 bp, Artificial Sequence
  Description of Artificial Sequence: Synthetic polynucleotide
  gi|Fabrus|C10_VH3-23_IGHD4-17*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctatgcttttgatgtctggggccaaggaaccctggtcaccgtctcctcagctagc

SEQ ID NO: 1400 - DNA, 374 bp, Artificial Sequence
  Description of Artificial Sequence: Synthetic polynucleotide
  gi|Fabrus|C11_VH3-23_IGHD4-17*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctatgcttttgatgtctggggccaaggaaccctggtcaccgtctcctcagctagc

SEQ ID NO: 1401 - DNA, 377 bp, Artificial Sequence
  Description of Artificial Sequence: Synthetic polynucleotide
  gi|Fabrus|C12_VH3-23_IGHD4-23*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctatgcttttgatgtctggggccaaggaaccctggtcaccgtctcctcagctagc

SEQ ID NO: 1402 - DNA, 377 bp, Artificial Sequence
  Description of Artificial Sequence: Synthetic polynucleotide
  gi|Fabrus|D01_VH3-23_IGHD4-23*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctatgcttttgatgtctggggccaaggaaccctggtcaccgtctcctcagctagc

SEQ ID NO: 1403 - DNA, 380 bp, Artificial Sequence
  Description of Artificial Sequence: Synthetic polynucleotide
  gi|Fabrus|D02_VH3-23_IGHD5-5*01(2)>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctatgcttttgatgtctggggccaaggaaccctggtcaccgtctcctcagctagc

SEQ ID NO: 1404 - DNA, 380 bp, Artificial Sequence
  Description of Artificial Sequence: Synthetic polynucleotide
  gi|Fabrus|D03_VH3-23_IGHD5-5*01(2)>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctatgcttttgatgtctggggccaaggaaccctggtcaccgtctcctcagctagc

SEQ ID NO: 1405 - DNA, 380 bp, Artificial Sequence
  Description of Artificial Sequence: Synthetic polynucleotide
  gi|Fabrus|D04_VH3-23_IGHD5-5*01(2)>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctatgcttttgatgtctggggccaaggaaccctggtcaccgtctcctcagctagc

SEQ ID NO: 1406 - DNA, 383 bp, Artificial Sequence
  Description of Artificial Sequence: Synthetic polynucleotide
  gi|Fabrus|D05_VH3-23_IGHD5-12*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctatgcttttgatgtctggggccaaggaaccctggtcaccgtctcctcagctagc

SEQ ID NO: 1407 - DNA, 383 bp, Artificial Sequence
  Description of Artificial Sequence: Synthetic polynucleotide
  gi|Fabrus|D06_VH3-23_IGHD5-12*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctatgcttttgatgtctggggccaaggaaccctggtcaccgtctcctcagctagc

SEQ ID NO: 1408 - DNA, 380 bp, Artificial Sequence; identical to SEQ ID NO: 1403
  Description of Artificial Sequence: Synthetic polynucleotide
  gi|Fabrus|D07_VH3-23_IGHD5-18*01(2)>1_IGHJ3*01

SEQ ID NO: 1409 - DNA, 380 bp, Artificial Sequence; identical to SEQ ID NO: 1404
  Description of Artificial Sequence: Synthetic polynucleotide
  gi|Fabrus|D08_VH3-23_IGHD5-18*01(2)>2_IGHJ3*01

SEQ ID NO: 1410 - DNA, 380 bp, Artificial Sequence; identical to SEQ ID NO: 1405
  Description of Artificial Sequence: Synthetic polynucleotide
  gi|Fabrus|D09_VH3-23_IGHD5-18*01(2)>3_IGHJ3*01

SEQ ID NO: 1411 - DNA, 380 bp, Artificial Sequence
  Description of Artificial Sequence: Synthetic polynucleotide
  gi|Fabrus|D10_VH3-23_IGHD5-24*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctatgcttttgatgtctggggccaaggaaccctggtcaccgtctcctcagctagc

SEQ ID NO: 1412 - DNA, 380 bp, Artificial Sequence
  Description of Artificial Sequence: Synthetic polynucleotide
  gi|Fabrus|D11_VH3-23_IGHD5-24*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctatgcttttgatgtctggggccaaggaaccctggtcaccgtctcctcagctagc

SEQ ID NO: 1413 - DNA, 377 bp, Artificial Sequence
  Description of Artificial Sequence: Synthetic polynucleotide
  gi|Fabrus|D12_VH3-23_IGHD6-6*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctatgcttttgatgtctggggccaaggaaccctggtcaccgtctcctcagctagc

SEQ ID NO: 1414 - DNA, 377 bp, Artificial Sequence
  Description of Artificial Sequence: Synthetic polynucleotide
  gi|Fabrus|E01_VH3-23_IGHD6-6*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctatgcttttgatgtctggggccaaggaaccctggtcaccgtctcctcagctagc

SEQ ID NO: 1415 - DNA, 380 bp, Artificial Sequence
  Description of Artificial Sequence: Synthetic polynucleotide
  gi|Fabrus|E02_VH3-23_IGHD6-13*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctatgcttttgatgtctggggccaaggaaccctggtcaccgtctcctcagctagc

SEQ ID NO: 1416 - DNA, 380 bp, Artificial Sequence
  Description of Artificial Sequence: Synthetic polynucleotide
  gi|Fabrus|E03_VH3-23_IGHD6-13*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctatgcttttgatgtctggggccaaggaaccctggtcaccgtctcctcagctagc

SEQ ID NO: 1417 - DNA, 380 bp, Artificial Sequence
  Description of Artificial Sequence: Synthetic polynucleotide
  gi|Fabrus|E04_VH3-23_IGHD6-19*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctatgcttttgatgtctggggccaaggaaccctggtcaccgtctcctcagctagc

SEQ ID NO: 1418 - DNA, 380 bp, Artificial Sequence
  Description of Artificial Sequence: Synthetic polynucleotide
  gi|Fabrus|E05_VH3-23_IGHD6-19*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctatgcttttgatgtctggggccaaggaaccctggtcaccgtctcctcagctagc

SEQ ID NO: 1419 - DNA, 377 bp, Artificial Sequence
  Description of Artificial Sequence: Synthetic polynucleotide
  gi|Fabrus|E06_VH3-23_IGHD6-25*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctatgcttttgatgtctggggccaaggaaccctggtcaccgtctcctcagctagc

SEQ ID NO: 1420 - DNA, 377 bp, Artificial Sequence
  Description of Artificial Sequence: Synthetic polynucleotide
  gi|Fabrus|E07_VH3-23_IGHD6-25*01>2_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctatgcttttgatgtctggggccaaggaaccctggtcaccgtctcctcagctagc

SEQ ID NO: 1421 - DNA, 371 bp, Artificial Sequence
  Description of Artificial Sequence: Synthetic polynucleotide
  gi|Fabrus|E08_VH3-23_IGHD7-27*01>1_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctatgcttttgatgtctggggccaaggaaccctggtcaccgtctcctcagctagc

SEQ ID NO: 1422 - DNA, 371 bp, Artificial Sequence
  Description of Artificial Sequence: Synthetic polynucleotide
  gi|Fabrus|E09_VH3-23_IGHD7-27*01>3_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctatgcttttgatgtctggggccaaggaaccctggtcaccgtctcctcagctagc

SEQ ID NO: 1423 - DNA, 377 bp, Artificial Sequence
  Description of Artificial Sequence: Synthetic polynucleotide
  gi|Fabrus|A01_VH3-23_IGHD1-1*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctatgcttttgatgtctggggccaaggaaccctggtcaccgtctcctcagctagc

SEQ ID NO: 1424 - DNA, 377 bp, Artificial Sequence
  Description of Artificial Sequence: Synthetic polynucleotide
  gi|Fabrus|A02_VH3-23_IGHD1-1*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctatgcttttgatgtctggggccaaggaaccctggtcaccgtctcctcagctagc

SEQ ID NO: 1425 - DNA, 377 bp, Artificial Sequence
  Description of Artificial Sequence: Synthetic polynucleotide
  gi|Fabrus|A03_VH3-23_IGHD1-1*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctatgcttttgatgtctggggccaaggaaccctggtcaccgtctcctcagctagc

SEQ ID NO: 1426 - DNA, 377 bp, Artificial Sequence
  Description of Artificial Sequence: Synthetic polynucleotide
  gi|Fabrus|A04_VH3-23_IGHD1-7*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctatgcttttgatgtctggggccaaggaaccctggtcaccgtctcctcagctagc

SEQ ID NO: 1427 - DNA, 377 bp, Artificial Sequence
  Description of Artificial Sequence: Synthetic polynucleotide
  gi|Fabrus|A05_VH3-23_IGHD1-7*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctatgcttttgatgtctggggccaaggaaccctggtcaccgtctcctcagctagc

SEQ ID NO: 1428 - DNA, 377 bp, Artificial Sequence
  Description of Artificial Sequence: Synthetic polynucleotide
  gi|Fabrus|A06_VH3-23_IGHD1-14*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctatgcttttgatgtctggggccaaggaaccctggtcaccgtctcctcagctagc

SEQ ID NO: 1429 - DNA, 377 bp, Artificial Sequence
  Description of Artificial Sequence: Synthetic polynucleotide
  gi|Fabrus|A07_VH3-23_IGHD1-14*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctatgcttttgatgtctggggccaaggaaccctggtcaccgtctcctcagctagc

SEQ ID NO: 1430 - DNA, 377 bp, Artificial Sequence
  Description of Artificial Sequence: Synthetic polynucleotide
  gi|Fabrus|A08_VH3-23_IGHD1-14*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctatgcttttgatgtctggggccaaggaaccctggtcaccgtctcctcagctagc

SEQ ID NO: 1431 - DNA, 377 bp, Artificial Sequence
  Description of Artificial Sequence: Synthetic polynucleotide
  gi|Fabrus|A09_VH3-23_IGHD1-20*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctatgcttttgatgtctggggccaaggaaccctggtcaccgtctcctcagctagc

SEQ ID NO: 1432 - DNA, 377 bp, Artificial Sequence
  Description of Artificial Sequence: Synthetic polynucleotide
  gi|Fabrus|A10_VH3-23_IGHD1-20*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctatgcttttgatgtctggggccaaggaaccctggtcaccgtctcctcagctagc

SEQ ID NO: 1433 - DNA, 377 bp, Artificial Sequence
  Description of Artificial Sequence: Synthetic polynucleotide
  gi|Fabrus|A11_VH3-23_IGHD1-20*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctatgcttttgatgtctggggccaaggaaccctggtcaccgtctcctcagctagc

SEQ ID NO: 1434 - DNA, 380 bp, Artificial Sequence
  Description of Artificial Sequence: Synthetic polynucleotide
  gi|Fabrus|A12_VH3-23_IGHD1-26*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctatgcttttgatgtctggggccaaggaaccctggtcaccgtctcctcagctagc

SEQ ID NO: 1435 - DNA, 380 bp, Artificial Sequence
  Description of Artificial Sequence: Synthetic polynucleotide
  gi|Fabrus|B01_VH3-23_IGHD1-26*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctatgcttttgatgtctggggccaaggaaccctggtcaccgtctcctcagctagc

SEQ ID NO: 1436 - DNA, 389 bp, Artificial Sequence
  Description of Artificial Sequence: Synthetic polynucleotide
  gi|Fabrus|B02_VH3-23_IGHD2-2*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctatgcttttgatgtctggggccaaggaaccctggtcaccgtctcctcagctagc

SEQ ID NO: 1437 - DNA, 389 bp, Artificial Sequence
  Description of Artificial Sequence: Synthetic polynucleotide
  gi|Fabrus|B03_VH3-23_IGHD2-2*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctatgcttttgatgtctggggccaaggaaccctggtcaccgtctcctcagctagc

SEQ ID NO: 1438 - DNA, 389 bp, Artificial Sequence
  Description of Artificial Sequence: Synthetic polynucleotide
  gi|Fabrus|B04_VH3-23_IGHD2-8*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctatgcttttgatgtctggggccaaggaaccctggtcaccgtctcctcagctagc

SEQ ID NO: 1439 - DNA, 389 bp, Artificial Sequence
  Description of Artificial Sequence: Synthetic polynucleotide
  gi|Fabrus|B05_VH3-23_IGHD2-15*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctatgcttttgatgtctggggccaaggaaccctggtcaccgtctcctcagctagc

SEQ ID NO: 1440 - DNA, 389 bp, Artificial Sequence
  Description of Artificial Sequence: Synthetic polynucleotide
  gi|Fabrus|B06_VH3-23_IGHD2-15*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctatgcttttgatgtctggggccaaggaaccctggtcaccgtctcctcagctagc

SEQ ID NO: 1441 - DNA, 386 bp, Artificial Sequence
  Description of Artificial Sequence: Synthetic polynucleotide
  gi|Fabrus|B07_VH3-23_IGHD2-21*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctatgcttttgatgtctggggccaaggaaccctggtcaccgtctcctcagctagc

SEQ ID NO: 1442 - DNA, 386 bp, Artificial Sequence
  Description of Artificial Sequence: Synthetic polynucleotide
  gi|Fabrus|B08_VH3-23_IGHD2-21*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctatgcttttgatgtctggggccaaggaaccctggtcaccgtctcctcagctagc

SEQ ID NO: 1443 - DNA, 389 bp, Artificial Sequence
  Description of Artificial Sequence: Synthetic polynucleotide
  gi|Fabrus|B09_VH3-23_IGHD3-3*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctatgcttttgatgtctggggccaaggaaccctggtcaccgtctcctcagctagc

SEQ ID NO: 1444 - DNA, 389 bp, Artificial Sequence
  Description of Artificial Sequence: Synthetic polynucleotide
  gi|Fabrus|B10_VH3-23_IGHD3-3*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctatgcttttgatgtctggggccaaggaaccctggtcaccgtctcctcagctagc

SEQ ID NO: 1445 - DNA, 389 bp, Artificial Sequence
  Description of Artificial Sequence: Synthetic polynucleotide
  gi|Fabrus|B11_VH3-23_IGHD3-9*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctatgcttttgatgtctggggccaaggaaccctggtcaccgtctcctcagctagc

SEQ ID NO: 1446 - DNA, 389 bp, Artificial Sequence
  Description of Artificial Sequence: Synthetic polynucleotide
  gi|Fabrus|B12_VH3-23_IGHD3-9*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctatgcttttgatgtctggggccaaggaaccctggtcaccgtctcctcagctagc

SEQ ID NO: 1447 - DNA, 389 bp, Artificial Sequence
  Description of Artificial Sequence: Synthetic polynucleotide
  gi|Fabrus|C01_VH3-23_IGHD3-10*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctatgcttttgatgtctggggccaaggaaccctggtcaccgtctcctcagctagc

SEQ ID NO: 1448 - DNA, 389 bp, Artificial Sequence
  Description of Artificial Sequence: Synthetic polynucleotide
  gi|Fabrus|C02_VH3-23_IGHD3-10*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctatgcttttgatgtctggggccaaggaaccctggtcaccgtctcctcagctagc

SEQ ID NO: 1449 - DNA, 395 bp, Artificial Sequence
  Description of Artificial Sequence: Synthetic polynucleotide
  gi|Fabrus|C03_VH3-23_IGHD3-16*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctatgcttttgatgtctggggccaaggaaccctggtcaccgtctcctcagctagc

SEQ ID NO: 1450 - DNA, 395 bp, Artificial Sequence
  Description of Artificial Sequence: Synthetic polynucleotide
  gi|Fabrus|C04_VH3-23_IGHD3-16*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctatgcttttgatgtctggggccaaggaaccctggtcaccgtctcctcagctagc

SEQ ID NO: 1451 - DNA, 389 bp, Artificial Sequence
  Description of Artificial Sequence: Synthetic polynucleotide
  gi|Fabrus|C05_VH3-23_IGHD3-22*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctatgcttttgatgtctggggccaaggaaccctggtcaccgtctcctcagctagc

SEQ ID NO: 1452 - DNA, 374 bp, Artificial Sequence
  Description of Artificial Sequence: Synthetic polynucleotide
  gi|Fabrus|C06_VH3-23_IGHD4-4*01(1)>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctatgcttttgatgtctggggccaaggaaccctggtcaccgtctcctcagctagc

SEQ ID NO: 1453 - DNA, 374 bp, Artificial Sequence
  Description of Artificial Sequence: Synthetic polynucleotide
  gi|Fabrus|C07_VH3-23_IGHD4-4*01(1)>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctatgcttttgatgtctggggccaaggaaccctggtcaccgtctcctcagctagc

SEQ ID NO: 1454 - DNA, 374 bp, Artificial Sequence; identical to SEQ ID NO: 1452
  Description of Artificial Sequence: Synthetic polynucleotide
  gi|Fabrus|C08_VH3-23_IGHD4-11*01(1)>1'_IGHJ3*01

SEQ ID NO: 1455 - DNA, 374 bp, Artificial Sequence; identical to SEQ ID NO: 1453
  Description of Artificial Sequence: Synthetic polynucleotide
  gi|Fabrus|C09_VH3-23_IGHD4-11*01(1)>3'_IGHJ3*01

SEQ ID NO: 1456 - DNA, 374 bp, Artificial Sequence
  Description of Artificial Sequence: Synthetic polynucleotide
  gi|Fabrus|C10_VH3-23_IGHD4-17*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctatgcttttgatgtctggggccaaggaaccctggtcaccgtctcctcagctagc

SEQ ID NO: 1457 - DNA, 374 bp, Artificial Sequence
  Description of Artificial Sequence: Synthetic polynucleotide
  gi|Fabrus|C11_VH3-23_IGHD4-17*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctatgcttttgatgtctggggccaaggaaccctggtcaccgtctcctcagctagc

SEQ ID NO: 1458 - DNA, 377 bp, Artificial Sequence
  Description of Artificial Sequence: Synthetic polynucleotide
  gi|Fabrus|C12_VH3-23_IGHD4-23*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctatgcttttgatgtctggggccaaggaaccctggtcaccgtctcctcagctagc

SEQ ID NO: 1459 - DNA, 377 bp, Artificial Sequence
  Description of Artificial Sequence: Synthetic polynucleotide
  gi|Fabrus|D01_VH3-23_IGHD4-23*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctatgcttttgatgtctggggccaaggaaccctggtcaccgtctcctcagctagc

SEQ ID NO: 1460 - DNA, 380 bp, Artificial Sequence
  Description of Artificial Sequence: Synthetic polynucleotide
  gi|Fabrus|D02_VH3-23_IGHD5-5*01(2)>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctatgcttttgatgtctggggccaaggaaccctggtcaccgtctcctcagctagc

SEQ ID NO: 1461 - DNA, 380 bp, Artificial Sequence
  Description of Artificial Sequence: Synthetic polynucleotide
  gi|Fabrus|D03_VH3-23_IGHD5-5*01(2)>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctatgcttttgatgtctggggccaaggaaccctggtcaccgtctcctcagctagc

SEQ ID NO: 1462 - DNA, 383 bp, Artificial Sequence
  Description of Artificial Sequence: Synthetic polynucleotide
  gi|Fabrus|D04_VH3-23_IGHD5-12*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctatgcttttgatgtctggggccaaggaaccctggtcaccgtctcctcagctagc

SEQ ID NO: 1463 - DNA, 383 bp, Artificial Sequence
  Description of Artificial Sequence: Synthetic polynucleotide
  gi|Fabrus|D05_VH3-23_IGHD5-12*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctatgcttttgatgtctggggccaaggaaccctggtcaccgtctcctcagctagc

SEQ ID NO: 1464 - DNA, 380 bp, Artificial Sequence; identical to SEQ ID NO: 1460
  Description of Artificial Sequence: Synthetic polynucleotide
  gi|Fabrus|D06_VH3-23_IGHD5-18*01(2)>1'_IGHJ3*01

SEQ ID NO: 1465 - DNA, 380 bp, Artificial Sequence; identical to SEQ ID NO: 1461
  Description of Artificial Sequence: Synthetic polynucleotide
  gi|Fabrus|D07_VH3-23_IGHD5-18*01(2)>3'_IGHJ3*01

SEQ ID NO: 1466 - DNA, 380 bp, Artificial Sequence
  Description of Artificial Sequence: Synthetic polynucleotide
  gi|Fabrus|D08_VH3-23_IGHD5-24*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctatgcttttgatgtctggggccaaggaaccctggtcaccgtctcctcagctagc

SEQ ID NO: 1467 - DNA, 380 bp, Artificial Sequence
  Description of Artificial Sequence: Synthetic polynucleotide
  gi|Fabrus|D09_VH3-23_IGHD5-24*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctatgcttttgatgtctggggccaaggaaccctggtcaccgtctcctcagctagc

SEQ ID NO: 1468 - DNA, 377 bp, Artificial Sequence
  Description of Artificial Sequence: Synthetic polynucleotide
  gi|Fabrus|D10_VH3-23_IGHD6-6*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctatgcttttgatgtctggggccaaggaaccctggtcaccgtctcctcagctagc

SEQ ID NO: 1469 - DNA, 377 bp, Artificial Sequence
  Description of Artificial Sequence: Synthetic polynucleotide
  gi|Fabrus|D11_VH3-23_IGHD6-6*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctatgcttttgatgtctggggccaaggaaccctggtcaccgtctcctcagctagc

SEQ ID NO: 1470 - DNA, 377 bp, Artificial Sequence
  Description of Artificial Sequence: Synthetic polynucleotide
  gi|Fabrus|D12_VH3-23_IGHD6-6*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctatgcttttgatgtctggggccaaggaaccctggtcaccgtctcctcagctagc

SEQ ID NO: 1471 - DNA, 380 bp, Artificial Sequence
  Description of Artificial Sequence: Synthetic polynucleotide
  gi|Fabrus|E01_VH3-23_IGHD6-13*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctatgcttttgatgtctggggccaaggaaccctggtcaccgtctcctcagctagc

SEQ ID NO: 1472 - DNA, 380 bp, Artificial Sequence
  Description of Artificial Sequence: Synthetic polynucleotide
  gi|Fabrus|E02_VH3-23_IGHD6-13*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctatgcttttgatgtctggggccaaggaaccctggtcaccgtctcctcagctagc

SEQ ID NO: 1473 - DNA, 380 bp, Artificial Sequence
  Description of Artificial Sequence: Synthetic polynucleotide
  gi|Fabrus|E03_VH3-23_IGHD6-13*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctatgcttttgatgtctggggccaaggaaccctggtcaccgtctcctcagctagc

SEQ ID NO: 1474 - DNA, 380 bp, Artificial Sequence
  Description of Artificial Sequence: Synthetic polynucleotide
  gi|Fabrus|E04_VH3-23_IGHD6-19*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctatgcttttgatgtctggggccaaggaaccctggtcaccgtctcctcagctagc

SEQ ID NO: 1475 - DNA, 380 bp, Artificial Sequence
  Description of Artificial Sequence: Synthetic polynucleotide
  gi|Fabrus|E05_VH3-23_IGHD6-19*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctatgcttttgatgtctggggccaaggaaccctggtcaccgtctcctcagctagc

SEQ ID NO: 1476 - DNA, 380 bp, Artificial Sequence
  Description of Artificial Sequence: Synthetic polynucleotide
  gi|Fabrus|E06_VH3-23_IGHD6-19*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctatgcttttgatgtctggggccaaggaaccctggtcaccgtctcctcagctagc

SEQ ID NO: 1477 - DNA, 377 bp, Artificial Sequence
  Description of Artificial Sequence: Synthetic polynucleotide
  gi|Fabrus|E07_VH3-23_IGHD6-25*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctatgcttttgatgtctggggccaaggaaccctggtcaccgtctcctcagctagc

SEQ ID NO: 1478 - DNA, 377 bp, Artificial Sequence
  Description of Artificial Sequence: Synthetic polynucleotide
  gi|Fabrus|E08_VH3-23_IGHD6-25*01>3'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctatgcttttgatgtctggggccaaggaaccctggtcaccgtctcctcagctagc

SEQ ID NO: 1479 - DNA, 371 bp, Artificial Sequence
  Description of Artificial Sequence: Synthetic polynucleotide
  gi|Fabrus|E09_VH3-23_IGHD7-27*01>1'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctatgcttttgatgtctggggccaaggaaccctggtcaccgtctcctcagctagc

SEQ ID NO: 1480 - DNA, 371 bp, Artificial Sequence
  Description of Artificial Sequence: Synthetic polynucleotide
  gi|Fabrus|E10_VH3-23_IGHD7-27*01>2'_IGHJ3*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctatgcttttgatgtctggggccaaggaaccctggtcaccgtctcctcagctagc

SEQ ID NO: 1481 - DNA, 377 bp, Artificial Sequence
  Description of Artificial Sequence: Synthetic polynucleotide
  gi|Fabrus|A01_VH3-23_IGHD1-1*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctactactttgactactggggccaaggaaccctggtcaccgtctcctcagctagc

SEQ ID NO: 1482 - DNA, 377 bp, Artificial Sequence
  Description of Artificial Sequence: Synthetic polynucleotide
  gi|Fabrus|A02_VH3-23_IGHD1-1*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctactactttgactactggggccaaggaaccctggtcaccgtctcctcagctagc

SEQ ID NO: 1483 - DNA, 377 bp, Artificial Sequence
  Description of Artificial Sequence: Synthetic polynucleotide
  gi|Fabrus|A03_VH3-23_IGHD1-1*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctactactttgactactggggccaaggaaccctggtcaccgtctcctcagctagc

SEQ ID NO: 1484 - DNA, 377 bp, Artificial Sequence
  Description of Artificial Sequence: Synthetic polynucleotide
  gi|Fabrus|A04_VH3-23_IGHD1-7*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctactactttgactactggggccaaggaaccctggtcaccgtctcctcagctagc

SEQ ID NO: 1485 - DNA, 377 bp, Artificial Sequence
  Description of Artificial Sequence: Synthetic polynucleotide
  gi|Fabrus|A05_VH3-23_IGHD1-7*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctactactttgactactggggccaaggaaccctggtcaccgtctcctcagctagc

SEQ ID NO: 1486 - DNA, 377 bp, Artificial Sequence
  Description of Artificial Sequence: Synthetic polynucleotide
  gi|Fabrus|A06_VH3-23_IGHD1-14*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctactactttgactactggggccaaggaaccctggtcaccgtctcctcagctagc

SEQ ID NO: 1487 - DNA, 377 bp, Artificial Sequence
  Description of Artificial Sequence: Synthetic polynucleotide
  gi|Fabrus|A07_VH3-23_IGHD1-14*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctactactttgactactggggccaaggaaccctggtcaccgtctcctcagctagc

SEQ ID NO: 1488 - DNA, 377 bp, Artificial Sequence
  Description of Artificial Sequence: Synthetic polynucleotide
  gi|Fabrus|A08_VH3-23_IGHD1-20*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctactactttgactactggggccaaggaaccctggtcaccgtctcctcagctagc

SEQ ID NO: 1489 - DNA, 377 bp, Artificial Sequence
  Description of Artificial Sequence: Synthetic polynucleotide
  gi|Fabrus|A09_VH3-23_IGHD1-20*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctactactttgactactggggccaaggaaccctggtcaccgtctcctcagctagc

SEQ ID NO: 1490 - DNA, 380 bp, Artificial Sequence
  Description of Artificial Sequence: Synthetic polynucleotide
  gi|Fabrus|A10_VH3-23_IGHD1-26*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctactactttgactactggggccaaggaaccctggtcaccgtctcctcagctagc

SEQ ID NO: 1491 - DNA, 380 bp, Artificial Sequence
  Description of Artificial Sequence: Synthetic polynucleotide
  gi|Fabrus|A11_VH3-23_IGHD1-26*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctactactttgactactggggccaaggaaccctggtcaccgtctcctcagctagc

SEQ ID NO: 1492 - DNA, 389 bp, Artificial Sequence
  Description of Artificial Sequence: Synthetic polynucleotide
  gi|Fabrus|A12_VH3-23_IGHD2-2*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctactactttgactactggggccaaggaaccctggtcaccgtctcctcagctagc

SEQ ID NO: 1493 - DNA, 389 bp, Artificial Sequence
  Description of Artificial Sequence: Synthetic polynucleotide
  gi|Fabrus|B01_VH3-23_IGHD2-2*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctactactttgactactggggccaaggaaccctggtcaccgtctcctcagctagc

SEQ ID NO: 1494 - DNA, 389 bp, Artificial Sequence
  Description of Artificial Sequence: Synthetic polynucleotide
  gi|Fabrus|B02_VH3-23_IGHD2-8*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctactactttgactactggggccaaggaaccctggtcaccgtctcctcagctagc

SEQ ID NO: 1495 - DNA, 389 bp, Artificial Sequence
  Description of Artificial Sequence: Synthetic polynucleotide
  gi|Fabrus|B03_VH3-23_IGHD2-8*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctactactttgactactggggccaaggaaccctggtcaccgtctcctcagctagc

SEQ ID NO: 1496 - DNA, 389 bp, Artificial Sequence
  Description of Artificial Sequence: Synthetic polynucleotide
  gi|Fabrus|B04_VH3-23_IGHD2-15*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctactactttgactactggggccaaggaaccctggtcaccgtctcctcagctagc

SEQ ID NO: 1497 - DNA, 389 bp, Artificial Sequence
  Description of Artificial Sequence: Synthetic polynucleotide
  gi|Fabrus|B05_VH3-23_IGHD2-15*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctactactttgactactggggccaaggaaccctggtcaccgtctcctcagctagc

SEQ ID NO: 1498 - DNA, 386 bp, Artificial Sequence
  Description of Artificial Sequence: Synthetic polynucleotide
  gi|Fabrus|B06_VH3-23_IGHD2-21*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctactactttgactactggggccaaggaaccctggtcaccgtctcctcagctagc

SEQ ID NO: 1499 - DNA, 386 bp, Artificial Sequence
  Description of Artificial Sequence: Synthetic polynucleotide
  gi|Fabrus|B07_VH3-23_IGHD2-21*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctactactttgactactggggccaaggaaccctggtcaccgtctcctcagctagc

SEQ ID NO: 1500 - DNA, 389 bp, Artificial Sequence
  Description of Artificial Sequence: Synthetic polynucleotide
  gi|Fabrus|B08_VH3-23_IGHD3-3*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctactactttgactactggggccaaggaaccctggtcaccgtctcctcagctagc

SEQ ID NO: 1501 - DNA, 389 bp, Artificial Sequence
  Description of Artificial Sequence: Synthetic polynucleotide
  gi|Fabrus|B09_VH3-23_IGHD3-3*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctactactttgactactggggccaaggaaccctggtcaccgtctcctcagctagc

SEQ ID NO: 1502 - DNA, 389 bp, Artificial Sequence
  Description of Artificial Sequence: Synthetic polynucleotide
  gi|Fabrus|B10_VH3-23_IGHD3-3*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctactactttgactactggggccaaggaaccctggtcaccgtctcctcagctagc

SEQ ID NO: 1503 - DNA, 389 bp, Artificial Sequence
  Description of Artificial Sequence: Synthetic polynucleotide
  gi|Fabrus|B11_VH3-23_IGHD3-9*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctactactttgactactggggccaaggaaccctggtcaccgtctcctcagctagc

SEQ ID NO: 1504 - DNA, 389 bp, Artificial Sequence
  Description of Artificial Sequence: Synthetic polynucleotide
  gi|Fabrus|B12_VH3-23_IGHD3-10*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctactactttgactactggggccaaggaaccctggtcaccgtctcctcagctagc

SEQ ID NO: 1505 - DNA, 389 bp, Artificial Sequence
  Description of Artificial Sequence: Synthetic polynucleotide
  gi|Fabrus|C01_VH3-23_IGHD3-10*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctactactttgactactggggccaaggaaccctggtcaccgtctcctcagctagc

SEQ ID NO: 1506 - DNA, 395 bp, Artificial Sequence
  Description of Artificial Sequence: Synthetic polynucleotide
  gi|Fabrus|C02_VH3-23_IGHD3-16*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctactactttgactactggggccaaggaaccctggtcaccgtctcctcagctagc

SEQ ID NO: 1507 - DNA, 395 bp, Artificial Sequence
  Description of Artificial Sequence: Synthetic polynucleotide
  gi|Fabrus|C03_VH3-23_IGHD3-16*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctactactttgactactggggccaaggaaccctggtcaccgtctcctcagctagc

SEQ ID NO: 1508 - DNA, 389 bp, Artificial Sequence
  Description of Artificial Sequence: Synthetic polynucleotide
  gi|Fabrus|C04_VH3-23_IGHD3-22*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctactactttgactactggggccaaggaaccctggtcaccgtctcctcagctagc

SEQ ID NO: 1509 - DNA, 389 bp, Artificial Sequence
  Description of Artificial Sequence: Synthetic polynucleotide
  gi|Fabrus|C05_VH3-23_IGHD3-22*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctactactttgactactggggccaaggaaccctggtcaccgtctcctcagctagc

SEQ ID NO: 1510 - DNA, 374 bp, Artificial Sequence
  Description of Artificial Sequence: Synthetic polynucleotide
  gi|Fabrus|C06_VH3-23_IGHD4-4*01(1)>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctactactttgactactggggccaaggaaccctggtcaccgtctcctcagctagc

SEQ ID NO: 1511 - DNA, 374 bp, Artificial Sequence
  Description of Artificial Sequence: Synthetic polynucleotide
  gi|Fabrus|C07_VH3-23_IGHD4-4*01(1)>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctactactttgactactggggccaaggaaccctggtcaccgtctcctcagctagc

SEQ ID NO: 1512 - DNA, 374 bp, Artificial Sequence; identical to SEQ ID NO: 1510
  Description of Artificial Sequence: Synthetic polynucleotide
  gi|Fabrus|C08_VH3-23_IGHD4-11*01(1)>2_IGHJ4*01

SEQ ID NO: 1513 - DNA, 374 bp, Artificial Sequence; identical to SEQ ID NO: 1511
  Description of Artificial Sequence: Synthetic polynucleotide
  gi|Fabrus|C09_VH3-23_IGHD4-11*01(1)>3_IGHJ4*01

SEQ ID NO: 1514 - DNA, 374 bp, Artificial Sequence
  Description of Artificial Sequence: Synthetic polynucleotide
  gi|Fabrus|C10_VH3-23_IGHD4-17*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctactactttgactactggggccaaggaaccctggtcaccgtctcctcagctagc

SEQ ID NO: 1515 - DNA, 374 bp, Artificial Sequence
  Description of Artificial Sequence: Synthetic polynucleotide
  gi|Fabrus|C11_VH3-23_IGHD4-17*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctactactttgactactggggccaaggaaccctggtcaccgtctcctcagctagc

SEQ ID NO: 1516 - DNA, 377 bp, Artificial Sequence
  Description of Artificial Sequence: Synthetic polynucleotide
  gi|Fabrus|C12_VH3-23_IGHD4-23*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctactactttgactactggggccaaggaaccctggtcaccgtctcctcagctagc

SEQ ID NO: 1517 - DNA, 377 bp, Artificial Sequence
  Description of Artificial Sequence: Synthetic polynucleotide
  gi|Fabrus|D01_VH3-23_IGHD4-23*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctactactttgactactggggccaaggaaccctggtcaccgtctcctcagctagc

SEQ ID NO: 1518 - DNA, 380 bp, Artificial Sequence
  Description of Artificial Sequence: Synthetic polynucleotide
  gi|Fabrus|D02_VH3-23_IGHD5-5*01(2)>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctactactttgactactggggccaaggaaccctggtcaccgtctcctcagctagc

SEQ ID NO: 1519 - DNA, 380 bp, Artificial Sequence
  Description of Artificial Sequence: Synthetic polynucleotide
  gi|Fabrus|D03_VH3-23_IGHD5-5*01(2)>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctactactttgactactggggccaaggaaccctggtcaccgtctcctcagctagc

SEQ ID NO: 1520 - DNA, 380 bp, Artificial Sequence
  Description of Artificial Sequence: Synthetic polynucleotide
  gi|Fabrus|D04_VH3-23_IGHD5-5*01(2)>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctactactttgactactggggccaaggaaccctggtcaccgtctcctcagctagc

SEQ ID NO: 1521 - DNA, 383 bp, Artificial Sequence
  Description of Artificial Sequence: Synthetic polynucleotide
  gi|Fabrus|D05_VH3-23_IGHD5-12*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctactactttgactactggggccaaggaaccctggtcaccgtctcctcagctagc

SEQ ID NO: 1522 - DNA, 383 bp, Artificial Sequence
  Description of Artificial Sequence: Synthetic polynucleotide
  gi|Fabrus|D06_VH3-23_IGHD5-12*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctactactttgactactggggccaaggaaccctggtcaccgtctcctcagctagc

SEQ ID NO: 1523 - DNA, 380 bp, Artificial Sequence; identical to SEQ ID NO: 1518
  Description of Artificial Sequence: Synthetic polynucleotide
  gi|Fabrus|D07_VH3-23_IGHD5-18*01(2)>1_IGHJ4*01

SEQ ID NO: 1524 - DNA, 380 bp, Artificial Sequence; identical to SEQ ID NO: 1519
  Description of Artificial Sequence: Synthetic polynucleotide
  gi|Fabrus|D08_VH3-23_IGHD5-18*01(2)>2_IGHJ4*01

SEQ ID NO: 1525 - DNA, 380 bp, Artificial Sequence; identical to SEQ ID NO: 1520
  Description of Artificial Sequence: Synthetic polynucleotide
  gi|Fabrus|D09_VH3-23_IGHD5-18*01(2)>3_IGHJ4*01

SEQ ID NO: 1526 - DNA, 380 bp, Artificial Sequence
  Description of Artificial Sequence: Synthetic polynucleotide
  gi|Fabrus|D10_VH3-23_IGHD5-24*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctactactttgactactggggccaaggaaccctggtcaccgtctcctcagctagc

SEQ ID NO: 1527 - DNA, 380 bp, Artificial Sequence
  Description of Artificial Sequence: Synthetic polynucleotide
  gi|Fabrus|D11_VH3-23_IGHD5-24*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctactactttgactactggggccaaggaaccctggtcaccgtctcctcagctagc

SEQ ID NO: 1528 - DNA, 377 bp, Artificial Sequence
  Description of Artificial Sequence: Synthetic polynucleotide
  gi|Fabrus|D12_VH3-23_IGHD6-6*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctactactttgactactggggccaaggaaccctggtcaccgtctcctcagctagc

SEQ ID NO: 1529 - DNA, 377 bp, Artificial Sequence
  Description of Artificial Sequence: Synthetic polynucleotide
  gi|Fabrus|E01_VH3-23_IGHD6-6*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctactactttgactactggggccaaggaaccctggtcaccgtctcctcagctagc

SEQ ID NO: 1530 - DNA, 380 bp, Artificial Sequence
  Description of Artificial Sequence: Synthetic polynucleotide
  gi|Fabrus|E02_VH3-23_IGHD6-13*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctactactttgactactggggccaaggaaccctggtcaccgtctcctcagctagc

SEQ ID NO: 1531 - DNA, 380 bp, Artificial Sequence
  Description of Artificial Sequence: Synthetic polynucleotide
  gi|Fabrus|E03_VH3-23_IGHD6-13*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctactactttgactactggggccaaggaaccctggtcaccgtctcctcagctagc

SEQ ID NO: 1532 - DNA, 380 bp, Artificial Sequence
  Description of Artificial Sequence: Synthetic polynucleotide
  gi|Fabrus|E04_VH3-23_IGHD6-19*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctactactttgactactggggccaaggaaccctggtcaccgtctcctcagctagc

SEQ ID NO: 1533 - DNA, 380 bp, Artificial Sequence
  Description of Artificial Sequence: Synthetic polynucleotide
  gi|Fabrus|E05_VH3-23_IGHD6-19*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctactactttgactactggggccaaggaaccctggtcaccgtctcctcagctagc

SEQ ID NO: 1534 - DNA, 377 bp, Artificial Sequence
  Description of Artificial Sequence: Synthetic polynucleotide
  gi|Fabrus|E06_VH3-23_IGHD6-25*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctactactttgactactggggccaaggaaccctggtcaccgtctcctcagctagc

SEQ ID NO: 1535 - DNA, 377 bp, Artificial Sequence
  Description of Artificial Sequence: Synthetic polynucleotide
  gi|Fabrus|E07_VH3-23_IGHD6-25*01>2_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctactactttgactactggggccaaggaaccctggtcaccgtctcctcagctagc

SEQ ID NO: 1536 - DNA, 371 bp, Artificial Sequence
  Description of Artificial Sequence: Synthetic polynucleotide
  gi|Fabrus|E08_VH3-23_IGHD7-27*01>1_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctactactttgactactggggccaaggaaccctggtcaccgtctcctcagctagc

SEQ ID NO: 1537 - DNA, 371 bp, Artificial Sequence
  Description of Artificial Sequence: Synthetic polynucleotide
  gi|Fabrus|E09_VH3-23_IGHD7-27*01>3_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctactactttgactactggggccaaggaaccctggtcaccgtctcctcagctagc

SEQ ID NO: 1538 - DNA, 377 bp, Artificial Sequence
  Description of Artificial Sequence: Synthetic polynucleotide
  gi|Fabrus|A01_VH3-23_IGHD1-1*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctactactttgactactggggccaaggaaccctggtcaccgtctcctcagctagc

SEQ ID NO: 1539 - DNA, 377 bp, Artificial Sequence
  Description of Artificial Sequence: Synthetic polynucleotide
  gi|Fabrus|A02_VH3-23_IGHD1-1*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctactactttgactactggggccaaggaaccctggtcaccgtctcctcagctagc

SEQ ID NO: 1540 - DNA, 377 bp, Artificial Sequence
  Description of Artificial Sequence: Synthetic polynucleotide
  gi|Fabrus|A03_VH3-23_IGHD1-1*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctactactttgactactggggccaaggaaccctggtcaccgtctcctcagctagc

SEQ ID NO: 1541 - DNA, 377 bp, Artificial Sequence
  Description of Artificial Sequence: Synthetic polynucleotide
  gi|Fabrus|A04_VH3-23_IGHD1-7*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctactactttgactactggggccaaggaaccctggtcaccgtctcctcagctagc

SEQ ID NO: 1542 - DNA, 377 bp, Artificial Sequence
  Description of Artificial Sequence: Synthetic polynucleotide
  gi|Fabrus|A05_VH3-23_IGHD1-7*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctactactttgactactggggccaaggaaccctggtcaccgtctcctcagctagc

SEQ ID NO: 1543 - DNA, 377 bp, Artificial Sequence
  Description of Artificial Sequence: Synthetic polynucleotide
  gi|Fabrus|A06_VH3-23_IGHD1-14*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctactactttgactactggggccaaggaaccctggtcaccgtctcctcagctagc

SEQ ID NO: 1544 - DNA, 377 bp, Artificial Sequence
  Description of Artificial Sequence: Synthetic polynucleotide
  gi|Fabrus|A07_VH3-23_IGHD1-14*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctactactttgactactggggccaaggaaccctggtcaccgtctcctcagctagc

SEQ ID NO: 1545 - DNA, 377 bp, Artificial Sequence
  Description of Artificial Sequence: Synthetic polynucleotide
  gi|Fabrus|A08_VH3-23_IGHD1-14*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctactactttgactactggggccaaggaaccctggtcaccgtctcctcagctagc

SEQ ID NO: 1546 - DNA, 377 bp, Artificial Sequence
  Description of Artificial Sequence: Synthetic polynucleotide
  gi|Fabrus|A09_VH3-23_IGHD1-20*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctactactttgactactggggccaaggaaccctggtcaccgtctcctcagctagc

SEQ ID NO: 1547 - DNA, 377 bp, Artificial Sequence
  Description of Artificial Sequence: Synthetic polynucleotide
  gi|Fabrus|A10_VH3-23_IGHD1-20*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctactactttgactactggggccaaggaaccctggtcaccgtctcctcagctagc

SEQ ID NO: 1548 - DNA, 377 bp, Artificial Sequence
  Description of Artificial Sequence: Synthetic polynucleotide
  gi|Fabrus|A11_VH3-23_IGHD1-20*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctactactttgactactggggccaaggaaccctggtcaccgtctcctcagctagc

SEQ ID NO: 1549 - DNA, 380 bp, Artificial Sequence
  Description of Artificial Sequence: Synthetic polynucleotide
  gi|Fabrus|A12_VH3-23_IGHD1-26*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctactactttgactactggggccaaggaaccctggtcaccgtctcctcagctagc

SEQ ID NO: 1550 - DNA, 380 bp, Artificial Sequence
  Description of Artificial Sequence: Synthetic polynucleotide
  gi|Fabrus|B01_VH3-23_IGHD1-26*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctactactttgactactggggccaaggaaccctggtcaccgtctcctcagctagc

SEQ ID NO: 1551 - DNA, 389 bp, Artificial Sequence
  Description of Artificial Sequence: Synthetic polynucleotide
  gi|Fabrus|B02_VH3-23_IGHD2-2*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctactactttgactactggggccaaggaaccctggtcaccgtctcctcagctagc

SEQ ID NO: 1552 - DNA, 389 bp, Artificial Sequence
  Description of Artificial Sequence: Synthetic polynucleotide
  gi|Fabrus|B03_VH3-23_IGHD2-2*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctactactttgactactggggccaaggaaccctggtcaccgtctcctcagctagc

SEQ ID NO: 1553 - DNA, 389 bp, Artificial Sequence
  Description of Artificial Sequence: Synthetic polynucleotide
  gi|Fabrus|B04_VH3-23_IGHD2-8*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctactactttgactactggggccaaggaaccctggtcaccgtctcctcagctagc

SEQ ID NO: 1554 - DNA, 389 bp, Artificial Sequence
  Description of Artificial Sequence: Synthetic polynucleotide
  gi|Fabrus|B05_VH3-23_IGHD2-15*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctactactttgactactggggccaaggaaccctggtcaccgtctcctcagctagc

SEQ ID NO: 1555 - DNA, 389 bp, Artificial Sequence
  Description of Artificial Sequence: Synthetic polynucleotide
  gi|Fabrus|B06_VH3-23_IGHD2-15*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctactactttgactactggggccaaggaaccctggtcaccgtctcctcagctagc

SEQ ID NO: 1556 - DNA, 386 bp, Artificial Sequence
  Description of Artificial Sequence: Synthetic polynucleotide
  gi|Fabrus|B07_VH3-23_IGHD2-21*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctactactttgactactggggccaaggaaccctggtcaccgtctcctcagctagc

SEQ ID NO: 1557 - DNA, 386 bp, Artificial Sequence
  Description of Artificial Sequence: Synthetic polynucleotide
  gi|Fabrus|B08_VH3-23_IGHD2-21*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctactactttgactactggggccaaggaaccctggtcaccgtctcctcagctagc

SEQ ID NO: 1558 - DNA, 389 bp, Artificial Sequence
  Description of Artificial Sequence: Synthetic polynucleotide
  gi|Fabrus|B09_VH3-23_IGHD3-3*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctactactttgactactggggccaaggaaccctggtcaccgtctcctcagctagc

SEQ ID NO: 1559 - DNA, 389 bp, Artificial Sequence
  Description of Artificial Sequence: Synthetic polynucleotide
  gi|Fabrus|B10_VH3-23_IGHD3-3*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctactactttgactactggggccaaggaaccctggtcaccgtctcctcagctagc

SEQ ID NO: 1560 - DNA, 389 bp, Artificial Sequence
  Description of Artificial Sequence: Synthetic polynucleotide
  gi|Fabrus|B11_VH3-23_IGHD3-9*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctactactttgactactggggccaaggaaccctggtcaccgtctcctcagctagc

SEQ ID NO: 1561 - DNA, 389 bp, Artificial Sequence
  Description of Artificial Sequence: Synthetic polynucleotide
  gi|Fabrus|B12_VH3-23_IGHD3-9*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctactactttgactactggggccaaggaaccctggtcaccgtctcctcagctagc

SEQ ID NO: 1562 - DNA, 389 bp, Artificial Sequence
  Description of Artificial Sequence: Synthetic polynucleotide
  gi|Fabrus|C01_VH3-23_IGHD3-10*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctactactttgactactggggccaaggaaccctggtcaccgtctcctcagctagc

SEQ ID NO: 1563 - DNA, 389 bp, Artificial Sequence
  Description of Artificial Sequence: Synthetic polynucleotide
  gi|Fabrus|C02_VH3-23_IGHD3-10*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctactactttgactactggggccaaggaaccctggtcaccgtctcctcagctagc

SEQ ID NO: 1564 - DNA, 395 bp, Artificial Sequence
  Description of Artificial Sequence: Synthetic polynucleotide
  gi|Fabrus|C03_VH3-23_IGHD3-16*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctactactttgactactggggccaaggaaccctggtcaccgtctcctcagctagc

SEQ ID NO: 1565 - DNA, 395 bp, Artificial Sequence
  Description of Artificial Sequence: Synthetic polynucleotide
  gi|Fabrus|C04_VH3-23_IGHD3-16*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctactactttgactactggggccaaggaaccctggtcaccgtctcctcagctagc

SEQ ID NO: 1566 - DNA, 389 bp, Artificial Sequence
  Description of Artificial Sequence: Synthetic polynucleotide
  gi|Fabrus|C05_VH3-23_IGHD3-22*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctactactttgactactggggccaaggaaccctggtcaccgtctcctcagctagc

SEQ ID NO: 1567 - DNA, 374 bp, Artificial Sequence
  Description of Artificial Sequence: Synthetic polynucleotide
  gi|Fabrus|C06_VH3-23_IGHD4-4*01(1)>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctactactttgactactggggccaaggaaccctggtcaccgtctcctcagctagc

SEQ ID NO: 1568 - DNA, 374 bp, Artificial Sequence
  Description of Artificial Sequence: Synthetic polynucleotide
  gi|Fabrus|C07_VH3-23_IGHD4-4*01(1)>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctactactttgactactggggccaaggaaccctggtcaccgtctcctcagctagc

SEQ ID NO: 1569 - DNA, 374 bp, Artificial Sequence; identical to SEQ ID NO: 1567
  Description of Artificial Sequence: Synthetic polynucleotide
  gi|Fabrus|C08_VH3-23_IGHD4-11*01(1)>1'_IGHJ4*01

SEQ ID NO: 1570 - DNA, 374 bp, Artificial Sequence; identical to SEQ ID NO: 1568
  Description of Artificial Sequence: Synthetic polynucleotide
  gi|Fabrus|C09_VH3-23_IGHD4-11*01(1)>3'_IGHJ4*01

SEQ ID NO: 1571 - DNA, 374 bp, Artificial Sequence
  Description of Artificial Sequence: Synthetic polynucleotide
  gi|Fabrus|C10_VH3-23_IGHD4-17*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctactactttgactactggggccaaggaaccctggtcaccgtctcctcagctagc

SEQ ID NO: 1572 - DNA, 374 bp, Artificial Sequence
  Description of Artificial Sequence: Synthetic polynucleotide
  gi|Fabrus|C11_VH3-23_IGHD4-17*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctactactttgactactggggccaaggaaccctggtcaccgtctcctcagctagc

SEQ ID NO: 1573 - DNA, 377 bp, Artificial Sequence
  Description of Artificial Sequence: Synthetic polynucleotide
  gi|Fabrus|C12_VH3-23_IGHD4-23*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctactactttgactactggggccaaggaaccctggtcaccgtctcctcagctagc

SEQ ID NO: 1574 - DNA, 377 bp, Artificial Sequence
  Description of Artificial Sequence: Synthetic polynucleotide
  gi|Fabrus|D01_VH3-23_IGHD4-23*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctactactttgactactggggccaaggaaccctggtcaccgtctcctcagctagc

SEQ ID NO: 1575 - DNA, 380 bp, Artificial Sequence
  Description of Artificial Sequence: Synthetic polynucleotide
  gi|Fabrus|D02_VH3-23_IGHD5-5*01(2)>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctactactttgactactggggccaaggaaccctggtcaccgtctcctcagctagc

SEQ ID NO: 1576 - DNA, 380 bp, Artificial Sequence
  Description of Artificial Sequence: Synthetic polynucleotide
  gi|Fabrus|D03_VH3-23_IGHD5-5*01(2)>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctactactttgactactggggccaaggaaccctggtcaccgtctcctcagctagc

SEQ ID NO: 1577 - DNA, 383 bp, Artificial Sequence
  Description of Artificial Sequence: Synthetic polynucleotide
  gi|Fabrus|D04_VH3-23_IGHD5-12*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctactactttgactactggggccaaggaaccctggtcaccgtctcctcagctagc

SEQ ID NO: 1578 - DNA, 383 bp, Artificial Sequence
  Description of Artificial Sequence: Synthetic polynucleotide
  gi|Fabrus|D05_VH3-23_IGHD5-12*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctactactttgactactggggccaaggaaccctggtcaccgtctcctcagctagc

SEQ ID NO: 1579 - DNA, 380 bp, Artificial Sequence; identical to SEQ ID NO: 1575
  Description of Artificial Sequence: Synthetic polynucleotide
  gi|Fabrus|D06_VH3-23_IGHD5-18*01(2)>1'_IGHJ4*01

SEQ ID NO: 1580 - DNA, 380 bp, Artificial Sequence; identical to SEQ ID NO: 1576
  Description of Artificial Sequence: Synthetic polynucleotide
  gi|Fabrus|D07_VH3-23_IGHD5-18*01(2)>3'_IGHJ4*01

SEQ ID NO: 1581 - DNA, 380 bp, Artificial Sequence
  Description of Artificial Sequence: Synthetic polynucleotide
  gi|Fabrus|D08_VH3-23_IGHD5-24*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctactactttgactactggggccaaggaaccctggtcaccgtctcctcagctagc

SEQ ID NO: 1582 - DNA, 380 bp, Artificial Sequence
  Description of Artificial Sequence: Synthetic polynucleotide
  gi|Fabrus|D09_VH3-23_IGHD5-24*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctactactttgactactggggccaaggaaccctggtcaccgtctcctcagctagc

SEQ ID NO: 1583 - DNA, 377 bp, Artificial Sequence
  Description of Artificial Sequence: Synthetic polynucleotide
  gi|Fabrus|D10_VH3-23_IGHD6-6*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctactactttgactactggggccaaggaaccctggtcaccgtctcctcagctagc

SEQ ID NO: 1584 - DNA, 377 bp, Artificial Sequence
  Description of Artificial Sequence: Synthetic polynucleotide
  gi|Fabrus|D11_VH3-23_IGHD6-6*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctactactttgactactggggccaaggaaccctggtcaccgtctcctcagctagc

SEQ ID NO: 1585 - DNA, 377 bp, Artificial Sequence
  Description of Artificial Sequence: Synthetic polynucleotide
  gi|Fabrus|D12_VH3-23_IGHD6-6*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctactactttgactactggggccaaggaaccctggtcaccgtctcctcagctagc

SEQ ID NO: 1586 - DNA, 380 bp, Artificial Sequence
  Description of Artificial Sequence: Synthetic polynucleotide
  gi|Fabrus|E01_VH3-23_IGHD6-13*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctactactttgactactggggccaaggaaccctggtcaccgtctcctcagctagc

SEQ ID NO: 1587 - DNA, 380 bp, Artificial Sequence
  Description of Artificial Sequence: Synthetic polynucleotide
  gi|Fabrus|E02_VH3-23_IGHD6-13*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctactactttgactactggggccaaggaaccctggtcaccgtctcctcagctagc

SEQ ID NO: 1588 - DNA, 380 bp, Artificial Sequence
  Description of Artificial Sequence: Synthetic polynucleotide
  gi|Fabrus|E03_VH3-23_IGHD6-13*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctactactttgactactggggccaaggaaccctggtcaccgtctcctcagctagc

SEQ ID NO: 1589 - DNA, 380 bp, Artificial Sequence
  Description of Artificial Sequence: Synthetic polynucleotide
  gi|Fabrus|E04_VH3-23_IGHD6-19*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctactactttgactactggggccaaggaaccctggtcaccgtctcctcagctagc

SEQ ID NO: 1590 - DNA, 380 bp, Artificial Sequence
  Description of Artificial Sequence: Synthetic polynucleotide
  gi|Fabrus|E05_VH3-23_IGHD6-19*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctactactttgactactggggccaaggaaccctggtcaccgtctcctcagctagc

SEQ ID NO: 1591 - DNA, 380 bp, Artificial Sequence
  Description of Artificial Sequence: Synthetic polynucleotide
  gi|Fabrus|E06_VH3-23_IGHD6-19*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctactactttgactactggggccaaggaaccctggtcaccgtctcctcagctagc

SEQ ID NO: 1592 - DNA, 377 bp, Artificial Sequence
  Description of Artificial Sequence: Synthetic polynucleotide
  gi|Fabrus|E07_VH3-23_IGHD6-25*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctactactttgactactggggccaaggaaccctggtcaccgtctcctcagctagc

SEQ ID NO: 1593 - DNA, 377 bp, Artificial Sequence
  Description of Artificial Sequence: Synthetic polynucleotide
  gi|Fabrus|E08_VH3-23_IGHD6-25*01>3'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctactactttgactactggggccaaggaaccctggtcaccgtctcctcagctagc

SEQ ID NO: 1594 - DNA, 371 bp, Artificial Sequence
  Description of Artificial Sequence: Synthetic polynucleotide
  gi|Fabrus|E09_VH3-23_IGHD7-27*01>1'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctactactttgactactggggccaaggaaccctggtcaccgtctcctcagctagc

SEQ ID NO: 1595 - DNA, 371 bp, Artificial Sequence
  Description of Artificial Sequence: Synthetic polynucleotide
  gi|Fabrus|E10_VH3-23_IGHD7-27*01>2'_IGHJ4*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctactactttgactactggggccaaggaaccctggtcaccgtctcctcagctagc

SEQ ID NO: 1596 - DNA, 380 bp, Artificial Sequence
  Description of Artificial Sequence: Synthetic polynucleotide
  gi|Fabrus|A01_VH3-23_IGHD1-1*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctacaactggttcgactactggggccaaggaaccctggtcaccgtctcctcagctagc

SEQ ID NO: 1597 - DNA, 380 bp, Artificial Sequence
  Description of Artificial Sequence: Synthetic polynucleotide
  gi|Fabrus|A02_VH3-23_IGHD1-1*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctacaactggttcgactactggggccaaggaaccctggtcaccgtctcctcagctagc

SEQ ID NO: 1598 - DNA, 380 bp, Artificial Sequence
  Description of Artificial Sequence: Synthetic polynucleotide
  gi|Fabrus|A03_VH3-23_IGHD1-1*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctacaactggttcgactactggggccaaggaaccctggtcaccgtctcctcagctagc

SEQ ID NO: 1599 - DNA, 380 bp, Artificial Sequence
  Description of Artificial Sequence: Synthetic polynucleotide
  gi|Fabrus|A04_VH3-23_IGHD1-7*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctacaactggttcgactactggggccaaggaaccctggtcaccgtctcctcagctagc

SEQ ID NO: 1600 - DNA, 380 bp, Artificial Sequence
  Description of Artificial Sequence: Synthetic polynucleotide
  gi|Fabrus|A05_VH3-23_IGHD1-7*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctacaactggttcgactactggggccaaggaaccctggtcaccgtctcctcagctagc

SEQ ID NO: 1601 - DNA, 380 bp, Artificial Sequence
  Description of Artificial Sequence: Synthetic polynucleotide
  gi|Fabrus|A06_VH3-23_IGHD1-14*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctacaactggttcgactactggggccaaggaaccctggtcaccgtctcctcagctagc

SEQ ID NO: 1602 - DNA, 380 bp, Artificial Sequence
  Description of Artificial Sequence: Synthetic polynucleotide
  gi|Fabrus|A07_VH3-23_IGHD1-14*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctacaactggttcgactactggggccaaggaaccctggtcaccgtctcctcagctagc

SEQ ID NO: 1603 - DNA, 380 bp, Artificial Sequence
  Description of Artificial Sequence: Synthetic polynucleotide
  gi|Fabrus|A08_VH3-23_IGHD1-20*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctacaactggttcgactactggggccaaggaaccctggtcaccgtctcctcagctagc

SEQ ID NO: 1604 - DNA, 380 bp, Artificial Sequence
  Description of Artificial Sequence: Synthetic polynucleotide
  gi|Fabrus|A09_VH3-23_IGHD1-20*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctacaactggttcgactactggggccaaggaaccctggtcaccgtctcctcagctagc

SEQ ID NO: 1605 - DNA, 383 bp, Artificial Sequence
  Description of Artificial Sequence: Synthetic polynucleotide
  gi|Fabrus|A10_VH3-23_IGHD1-26*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctacaactggttcgactactggggccaaggaaccctggtcaccgtctcctcagctagc

SEQ ID NO: 1606 - DNA, 383 bp, Artificial Sequence
  Description of Artificial Sequence: Synthetic polynucleotide
  gi|Fabrus|A11_VH3-23_IGHD1-26*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctacaactggttcgactactggggccaaggaaccctggtcaccgtctcctcagctagc

SEQ ID NO: 1607 - DNA, 392 bp, Artificial Sequence
  Description of Artificial Sequence: Synthetic polynucleotide
  gi|Fabrus|A12_VH3-23_IGHD2-2*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctacaactggttcgactactggggccaaggaaccctggtcaccgtctcctcagctagc

SEQ ID NO: 1608 - DNA, 392 bp, Artificial Sequence
  Description of Artificial Sequence: Synthetic polynucleotide
  gi|Fabrus|B01_VH3-23_IGHD2-2*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctacaactggttcgactactggggccaaggaaccctggtcaccgtctcctcagctagc

SEQ ID NO: 1609 - DNA, 392 bp, Artificial Sequence
  Description of Artificial Sequence: Synthetic polynucleotide
  gi|Fabrus|B02_VH3-23_IGHD2-8*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctacaactggttcgactactggggccaaggaaccctggtcaccgtctcctcagctagc

SEQ ID NO: 1610 - DNA, 392 bp, Artificial Sequence
  Description of Artificial Sequence: Synthetic polynucleotide
  gi|Fabrus|B03_VH3-23_IGHD2-8*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctacaactggttcgactactggggccaaggaaccctggtcaccgtctcctcagctagc

SEQ ID NO: 1611 - DNA, 392 bp, Artificial Sequence
  Description of Artificial Sequence: Synthetic polynucleotide
  gi|Fabrus|B04_VH3-23_IGHD2-15*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctacaactggttcgactactggggccaaggaaccctggtcaccgtctcctcagctagc

SEQ ID NO: 1612 - DNA, 392 bp, Artificial Sequence
  Description of Artificial Sequence: Synthetic polynucleotide
  gi|Fabrus|B05_VH3-23_IGHD2-15*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctacaactggttcgactactggggccaaggaaccctggtcaccgtctcctcagctagc

SEQ ID NO: 1613 - DNA, 389 bp, Artificial Sequence
  Description of Artificial Sequence: Synthetic polynucleotide
  gi|Fabrus|B06_VH3-23_IGHD2-21*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctacaactggttcgactactggggccaaggaaccctggtcaccgtctcctcagctagc

SEQ ID NO: 1614 - DNA, 389 bp, Artificial Sequence
  Description of Artificial Sequence: Synthetic polynucleotide
  gi|Fabrus|B07_VH3-23_IGHD2-21*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctacaactggttcgactactggggccaaggaaccctggtcaccgtctcctcagctagc

SEQ ID NO: 1615 - DNA, 392 bp, Artificial Sequence
  Description of Artificial Sequence: Synthetic polynucleotide
  gi|Fabrus|B08_VH3-23_IGHD3-3*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctacaactggttcgactactggggccaaggaaccctggtcaccgtctcctcagctagc

SEQ ID NO: 1616 - DNA, 392 bp, Artificial Sequence
  Description of Artificial Sequence: Synthetic polynucleotide
  gi|Fabrus|B09_VH3-23_IGHD3-3*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctacaactggttcgactactggggccaaggaaccctggtcaccgtctcctcagctagc

SEQ ID NO: 1617 - DNA, 392 bp, Artificial Sequence
  Description of Artificial Sequence: Synthetic polynucleotide
  gi|Fabrus|B10_VH3-23_IGHD3-3*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctacaactggttcgactactggggccaaggaaccctggtcaccgtctcctcagctagc

SEQ ID NO: 1618 - DNA, 392 bp, Artificial Sequence
  Description of Artificial Sequence: Synthetic polynucleotide
  gi|Fabrus|B11_VH3-23_IGHD3-9*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctacaactggttcgactactggggccaaggaaccctggtcaccgtctcctcagctagc

SEQ ID NO: 1619 - DNA, 392 bp, Artificial Sequence
  Description of Artificial Sequence: Synthetic polynucleotide
  gi|Fabrus|B12_VH3-23_IGHD3-10*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctacaactggttcgactactggggccaaggaaccctggtcaccgtctcctcagctagc

SEQ ID NO: 1620 - DNA, 392 bp, Artificial Sequence
  Description of Artificial Sequence: Synthetic polynucleotide
  gi|Fabrus|C01_VH3-23_IGHD3-10*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctacaactggttcgactactggggccaaggaaccctggtcaccgtctcctcagctagc

SEQ ID NO: 1621 - DNA, 398 bp, Artificial Sequence
  Description of Artificial Sequence: Synthetic polynucleotide
  gi|Fabrus|C02_VH3-23_IGHD3-16*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctacaactggttcgactactggggccaaggaaccctggtcaccgtctcctcagctagc

SEQ ID NO: 1622 - DNA, 398 bp, Artificial Sequence
  Description of Artificial Sequence: Synthetic polynucleotide
  gi|Fabrus|C03_VH3-23_IGHD3-16*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctacaactggttcgactactggggccaaggaaccctggtcaccgtctcctcagctagc

SEQ ID NO: 1623 - DNA, 392 bp, Artificial Sequence
  Description of Artificial Sequence: Synthetic polynucleotide
  gi|Fabrus|C04_VH3-23_IGHD3-22*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctacaactggttcgactactggggccaaggaaccctggtcaccgtctcctcagctagc

SEQ ID NO: 1624 - DNA, 392 bp, Artificial Sequence
  Description of Artificial Sequence: Synthetic polynucleotide
  gi|Fabrus|C05_VH3-23_IGHD3-22*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctacaactggttcgactactggggccaaggaaccctggtcaccgtctcctcagctagc

SEQ ID NO: 1625 - DNA, 377 bp, Artificial Sequence
  Description of Artificial Sequence: Synthetic polynucleotide
  gi|Fabrus|C06_VH3-23_IGHD4-4*01(1)>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctacaactggttcgactactggggccaaggaaccctggtcaccgtctcctcagctagc

SEQ ID NO: 1626 - DNA, 377 bp, Artificial Sequence
  Description of Artificial Sequence: Synthetic polynucleotide
  gi|Fabrus|C07_VH3-23_IGHD4-4*01(1)>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctacaactggttcgactactggggccaaggaaccctggtcaccgtctcctcagctagc

SEQ ID NO: 1627 - DNA, 377 bp, Artificial Sequence; identical to SEQ ID NO: 1625
  Description of Artificial Sequence: Synthetic polynucleotide
  gi|Fabrus|C08_VH3-23_IGHD4-11*01(1)>2_IGHJ5*01

SEQ ID NO: 1628 - DNA, 377 bp, Artificial Sequence; identical to SEQ ID NO: 1626
  Description of Artificial Sequence: Synthetic polynucleotide
  gi|Fabrus|C09_VH3-23_IGHD4-11*01(1)>3_IGHJ5*01

SEQ ID NO: 1629 - DNA, 377 bp, Artificial Sequence
  Description of Artificial Sequence: Synthetic polynucleotide
  gi|Fabrus|C10_VH3-23_IGHD4-17*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctacaactggttcgactactggggccaaggaaccctggtcaccgtctcctcagctagc

SEQ ID NO: 1630 - DNA, 377 bp, Artificial Sequence
  Description of Artificial Sequence: Synthetic polynucleotide
  gi|Fabrus|C11_VH3-23_IGHD4-17*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctacaactggttcgactactggggccaaggaaccctggtcaccgtctcctcagctagc

SEQ ID NO: 1631 - DNA, 380 bp, Artificial Sequence
  Description of Artificial Sequence: Synthetic polynucleotide
  gi|Fabrus|C12_VH3-23_IGHD4-23*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctacaactggttcgactactggggccaaggaaccctggtcaccgtctcctcagctagc

SEQ ID NO: 1632 - DNA, 380 bp, Artificial Sequence
  Description of Artificial Sequence: Synthetic polynucleotide
  gi|Fabrus|D01_VH3-23_IGHD4-23*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctacaactggttcgactactggggccaaggaaccctggtcaccgtctcctcagctagc

SEQ ID NO: 1633 - DNA, 383 bp, Artificial Sequence
  Description of Artificial Sequence: Synthetic polynucleotide
  gi|Fabrus|D02_VH3-23_IGHD5-5*01(2)>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctacaactggttcgactactggggccaaggaaccctggtcaccgtctcctcagctagc

SEQ ID NO: 1634 - DNA, 383 bp, Artificial Sequence
  Description of Artificial Sequence: Synthetic polynucleotide
  gi|Fabrus|D03_VH3-23_IGHD5-5*01(2)>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctacaactggttcgactactggggccaaggaaccctggtcaccgtctcctcagctagc

SEQ ID NO: 1635 - DNA, 383 bp, Artificial Sequence
  Description of Artificial Sequence: Synthetic polynucleotide
  gi|Fabrus|D04_VH3-23_IGHD5-5*01(2)>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctacaactggttcgactactggggccaaggaaccctggtcaccgtctcctcagctagc

SEQ ID NO: 1636 - DNA, 386 bp, Artificial Sequence
  Description of Artificial Sequence: Synthetic polynucleotide
  gi|Fabrus|D05_VH3-23_IGHD5-12*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctacaactggttcgactactggggccaaggaaccctggtcaccgtctcctcagctagc

SEQ ID NO: 1637 - DNA, 386 bp, Artificial Sequence
  Description of Artificial Sequence: Synthetic polynucleotide
  gi|Fabrus|D06_VH3-23_IGHD5-12*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctacaactggttcgactactggggccaaggaaccctggtcaccgtctcctcagctagc

SEQ ID NO: 1638 - DNA, 383 bp, Artificial Sequence; identical to SEQ ID NO: 1633
  Description of Artificial Sequence: Synthetic polynucleotide
  gi|Fabrus|D07_VH3-23_IGHD5-18*01(2)>1_IGHJ5*01

SEQ ID NO: 1639 - DNA, 383 bp, Artificial Sequence; identical to SEQ ID NO: 1634
  Description of Artificial Sequence: Synthetic polynucleotide
  gi|Fabrus|D08_VH3-23_IGHD5-18*01(2)>2_IGHJ5*01

SEQ ID NO: 1640 - DNA, 383 bp, Artificial Sequence; identical to SEQ ID NO: 1635
  Description of Artificial Sequence: Synthetic polynucleotide
  gi|Fabrus|D09_VH3-23_IGHD5-18*01(2)>3_IGHJ5*01

SEQ ID NO: 1641 - DNA, 383 bp, Artificial Sequence
  Description of Artificial Sequence: Synthetic polynucleotide
  gi|Fabrus|D10_VH3-23_IGHD5-24*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctacaactggttcgactactggggccaaggaaccctggtcaccgtctcctcagctagc

SEQ ID NO: 1642 - DNA, 383 bp, Artificial Sequence
  Description of Artificial Sequence: Synthetic polynucleotide
  gi|Fabrus|D11_VH3-23_IGHD5-24*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctacaactggttcgactactggggccaaggaaccctggtcaccgtctcctcagctagc

SEQ ID NO: 1643 - DNA, 380 bp, Artificial Sequence
  Description of Artificial Sequence: Synthetic polynucleotide
  gi|Fabrus|D12_VH3-23_IGHD6-6*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctacaactggttcgactactggggccaaggaaccctggtcaccgtctcctcagctagc

SEQ ID NO: 1644 - DNA, 380 bp, Artificial Sequence
  Description of Artificial Sequence: Synthetic polynucleotide
  gi|Fabrus|E01_VH3-23_IGHD6-6*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctacaactggttcgactactggggccaaggaaccctggtcaccgtctcctcagctagc

SEQ ID NO: 1645 - DNA, 383 bp, Artificial Sequence
  Description of Artificial Sequence: Synthetic polynucleotide
  gi|Fabrus|E02_VH3-23_IGHD6-13*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctacaactggttcgactactggggccaaggaaccctggtcaccgtctcctcagctagc

SEQ ID NO: 1646 - DNA, 383 bp, Artificial Sequence
  Description of Artificial Sequence: Synthetic polynucleotide
  gi|Fabrus|E03_VH3-23_IGHD6-13*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctacaactggttcgactactggggccaaggaaccctggtcaccgtctcctcagctagc

SEQ ID NO: 1647 - DNA, 383 bp, Artificial Sequence
  Description of Artificial Sequence: Synthetic polynucleotide
  gi|Fabrus|E04_VH3-23_IGHD6-19*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctacaactggttcgactactggggccaaggaaccctggtcaccgtctcctcagctagc

SEQ ID NO: 1648 - DNA, 383 bp, Artificial Sequence
  Description of Artificial Sequence: Synthetic polynucleotide
  gi|Fabrus|E05_VH3-23_IGHD6-19*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctacaactggttcgactactggggccaaggaaccctggtcaccgtctcctcagctagc

SEQ ID NO: 1649 - DNA, 380 bp, Artificial Sequence
  Description of Artificial Sequence: Synthetic polynucleotide
  gi|Fabrus|E06_VH3-23_IGHD6-25*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctacaactggttcgactactggggccaaggaaccctggtcaccgtctcctcagctagc

SEQ ID NO: 1650 - DNA, 380 bp, Artificial Sequence
  Description of Artificial Sequence: Synthetic polynucleotide
  gi|Fabrus|E07_VH3-23_IGHD6-25*01>2_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctacaactggttcgactactggggccaaggaaccctggtcaccgtctcctcagctagc

SEQ ID NO: 1651 - DNA, 374 bp, Artificial Sequence
  Description of Artificial Sequence: Synthetic polynucleotide
  gi|Fabrus|E08_VH3-23_IGHD7-27*01>1_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctacaactggttcgactactggggccaaggaaccctggtcaccgtctcctcagctagc

SEQ ID NO: 1652 - DNA, 374 bp, Artificial Sequence
  Description of Artificial Sequence: Synthetic polynucleotide
  gi|Fabrus|E09_VH3-23_IGHD7-27*01>3_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctacaactggttcgactactggggccaaggaaccctggtcaccgtctcctcagctagc

SEQ ID NO: 1653 - DNA, 380 bp, Artificial Sequence
  Description of Artificial Sequence: Synthetic polynucleotide
  gi|Fabrus|A01_VH3-23_IGHD1-1*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctacaactggttcgactactggggccaaggaaccctggtcaccgtctcctcagctagc

SEQ ID NO: 1654 - DNA, 380 bp, Artificial Sequence
  Description of Artificial Sequence: Synthetic polynucleotide
  gi|Fabrus|A02_VH3-23_IGHD1-1*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctacaactggttcgactactggggccaaggaaccctggtcaccgtctcctcagctagc

SEQ ID NO: 1655 - DNA, 380 bp, Artificial Sequence
  Description of Artificial Sequence: Synthetic polynucleotide
  gi|Fabrus|A03_VH3-23_IGHD1-1*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctacaactggttcgactactggggccaaggaaccctggtcaccgtctcctcagctagc

SEQ ID NO: 1656 - DNA, 380 bp, Artificial Sequence
  Description of Artificial Sequence: Synthetic polynucleotide
  gi|Fabrus|A04_VH3-23_IGHD1-7*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctacaactggttcgactactggggccaaggaaccctggtcaccgtctcctcagctagc

SEQ ID NO: 1657 - DNA, 380 bp, Artificial Sequence
  Description of Artificial Sequence: Synthetic polynucleotide
  gi|Fabrus|A05_VH3-23_IGHD1-7*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctacaactggttcgactactggggccaaggaaccctggtcaccgtctcctcagctagc

SEQ ID NO: 1658 - DNA, 380 bp, Artificial Sequence
  Description of Artificial Sequence: Synthetic polynucleotide
  gi|Fabrus|A06_VH3-23_IGHD1-14*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctacaactggttcgactactggggccaaggaaccctggtcaccgtctcctcagctagc

SEQ ID NO: 1659 - DNA, 380 bp, Artificial Sequence
  Description of Artificial Sequence: Synthetic polynucleotide
  gi|Fabrus|A07_VH3-23_IGHD1-14*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctacaactggttcgactactggggccaaggaaccctggtcaccgtctcctcagctagc

SEQ ID NO: 1660 - DNA, 380 bp, Artificial Sequence
  Description of Artificial Sequence: Synthetic polynucleotide
  gi|Fabrus|A08_VH3-23_IGHD1-14*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctacaactggttcgactactggggccaaggaaccctggtcaccgtctcctcagctagc

SEQ ID NO: 1661 - DNA, 380 bp, Artificial Sequence
  Description of Artificial Sequence: Synthetic polynucleotide
  gi|Fabrus|A09_VH3-23_IGHD1-20*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctacaactggttcgactactggggccaaggaaccctggtcaccgtctcctcagctagc

SEQ ID NO: 1662 - DNA, 380 bp, Artificial Sequence
  Description of Artificial Sequence: Synthetic polynucleotide
  gi|Fabrus|A10_VH3-23_IGHD1-20*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctacaactggttcgactactggggccaaggaaccctggtcaccgtctcctcagctagc

SEQ ID NO: 1663 - DNA, 380 bp, Artificial Sequence
  Description of Artificial Sequence: Synthetic polynucleotide
  gi|Fabrus|A11_VH3-23_IGHD1-20*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctacaactggttcgactactggggccaaggaaccctggtcaccgtctcctcagctagc

SEQ ID NO: 1664 - DNA, 383 bp, Artificial Sequence
  Description of Artificial Sequence: Synthetic polynucleotide
  gi|Fabrus|A12_VH3-23_IGHD1-26*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctacaactggttcgactactggggccaaggaaccctggtcaccgtctcctcagctagc

SEQ ID NO: 1665 - DNA, 383 bp, Artificial Sequence
  Description of Artificial Sequence: Synthetic polynucleotide
  gi|Fabrus|B01_VH3-23_IGHD1-26*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctacaactggttcgactactggggccaaggaaccctggtcaccgtctcctcagctagc

SEQ ID NO: 1666 - DNA, 392 bp, Artificial Sequence
  Description of Artificial Sequence: Synthetic polynucleotide
  gi|Fabrus|B02_VH3-23_IGHD2-2*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctacaactggttcgactactggggccaaggaaccctggtcaccgtctcctcagctagc

SEQ ID NO: 1667 - DNA, 392 bp, Artificial Sequence
  Description of Artificial Sequence: Synthetic polynucleotide
  gi|Fabrus|B03_VH3-23_IGHD2-2*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctacaactggttcgactactggggccaaggaaccctggtcaccgtctcctcagctagc

SEQ ID NO: 1668 - DNA, 392 bp, Artificial Sequence
  Description of Artificial Sequence: Synthetic polynucleotide
  gi|Fabrus|B04_VH3-23_IGHD2-8*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctacaactggttcgactactggggccaaggaaccctggtcaccgtctcctcagctagc

SEQ ID NO: 1669 - DNA, 392 bp, Artificial Sequence
  Description of Artificial Sequence: Synthetic polynucleotide
  gi|Fabrus|B05_VH3-23_IGHD2-15*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctacaactggttcgactactggggccaaggaaccctggtcaccgtctcctcagctagc

SEQ ID NO: 1670 - DNA, 392 bp, Artificial Sequence
  Description of Artificial Sequence: Synthetic polynucleotide
  gi|Fabrus|B06_VH3-23_IGHD2-15*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctacaactggttcgactactggggccaaggaaccctggtcaccgtctcctcagctagc

SEQ ID NO: 1671 - DNA, 389 bp, Artificial Sequence
  Description of Artificial Sequence: Synthetic polynucleotide
  gi|Fabrus|B07_VH3-23_IGHD2-21*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctacaactggttcgactactggggccaaggaaccctggtcaccgtctcctcagctagc

SEQ ID NO: 1672 - DNA, 389 bp, Artificial Sequence
  Description of Artificial Sequence: Synthetic polynucleotide
  gi|Fabrus|B08_VH3-23_IGHD2-21*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctacaactggttcgactactggggccaaggaaccctggtcaccgtctcctcagctagc

SEQ ID NO: 1673 - DNA, 392 bp, Artificial Sequence
  Description of Artificial Sequence: Synthetic polynucleotide
  gi|Fabrus|B09_VH3-23_IGHD3-3*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctacaactggttcgactactggggccaaggaaccctggtcaccgtctcctcagctagc

SEQ ID NO: 1674 - DNA, 392 bp, Artificial Sequence
  Description of Artificial Sequence: Synthetic polynucleotide
  gi|Fabrus|B10_VH3-23_IGHD3-3*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctacaactggttcgactactggggccaaggaaccctggtcaccgtctcctcagctagc

SEQ ID NO: 1675 - DNA, 392 bp, Artificial Sequence
  Description of Artificial Sequence: Synthetic polynucleotide
  gi|Fabrus|B11_VH3-23_IGHD3-9*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctacaactggttcgactactggggccaaggaaccctggtcaccgtctcctcagctagc

SEQ ID NO: 1676 - DNA, 392 bp, Artificial Sequence
  Description of Artificial Sequence: Synthetic polynucleotide
  gi|Fabrus|B12_VH3-23_IGHD3-9*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctacaactggttcgactactggggccaaggaaccctggtcaccgtctcctcagctagc

SEQ ID NO: 1677 - DNA, 392 bp, Artificial Sequence
  Description of Artificial Sequence: Synthetic polynucleotide
  gi|Fabrus|C01_VH3-23_IGHD3-10*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctacaactggttcgactactggggccaaggaaccctggtcaccgtctcctcagctagc

SEQ ID NO: 1678 - DNA, 392 bp, Artificial Sequence
  Description of Artificial Sequence: Synthetic polynucleotide
  gi|Fabrus|C02_VH3-23_IGHD3-10*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctacaactggttcgactactggggccaaggaaccctggtcaccgtctcctcagctagc

SEQ ID NO: 1679 - DNA, 398 bp, Artificial Sequence
  Description of Artificial Sequence: Synthetic polynucleotide
  gi|Fabrus|C03_VH3-23_IGHD3-16*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctacaactggttcgactactggggccaaggaaccctggtcaccgtctcctcagctagc

SEQ ID NO: 1680 - DNA, 398 bp, Artificial Sequence
  Description of Artificial Sequence: Synthetic polynucleotide
  gi|Fabrus|C04_VH3-23_IGHD3-16*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctacaactggttcgactactggggccaaggaaccctggtcaccgtctcctcagctagc

SEQ ID NO: 1681 - DNA, 392 bp, Artificial Sequence
  Description of Artificial Sequence: Synthetic polynucleotide
  gi|Fabrus|C05_VH3-23_IGHD3-22*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctacaactggttcgactactggggccaaggaaccctggtcaccgtctcctcagctagc

SEQ ID NO: 1682 - DNA, 377 bp, Artificial Sequence
  Description of Artificial Sequence: Synthetic polynucleotide
  gi|Fabrus|C06_VH3-23_IGHD4-4*01(1)>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctacaactggttcgactactggggccaaggaaccctggtcaccgtctcctcagctagc

SEQ ID NO: 1683 - DNA, 377 bp, Artificial Sequence
  Description of Artificial Sequence: Synthetic polynucleotide
  gi|Fabrus|C07_VH3-23_IGHD4-4*01(1)>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctacaactggttcgactactggggccaaggaaccctggtcaccgtctcctcagctagc

SEQ ID NO: 1684 - DNA, 377 bp, Artificial Sequence; identical to SEQ ID NO: 1682
  Description of Artificial Sequence: Synthetic polynucleotide
  gi|Fabrus|C08_VH3-23_IGHD4-11*01(1)>1'_IGHJ5*01

SEQ ID NO: 1685 - DNA, 377 bp, Artificial Sequence; identical to SEQ ID NO: 1683
  Description of Artificial Sequence: Synthetic polynucleotide
  gi|Fabrus|C09_VH3-23_IGHD4-11*01(1)>3'_IGHJ5*01

SEQ ID NO: 1686 - DNA, 377 bp, Artificial Sequence
  Description of Artificial Sequence: Synthetic polynucleotide
  gi|Fabrus|C10_VH3-23_IGHD4-17*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctacaactggttcgactactggggccaaggaaccctggtcaccgtctcctcagctagc

SEQ ID NO: 1687 - DNA, 377 bp, Artificial Sequence
  Description of Artificial Sequence: Synthetic polynucleotide
  gi|Fabrus|C11_VH3-23_IGHD4-17*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctacaactggttcgactactggggccaaggaaccctggtcaccgtctcctcagctagc

SEQ ID NO: 1688 - DNA, 380 bp, Artificial Sequence
  Description of Artificial Sequence: Synthetic polynucleotide
  gi|Fabrus|C12_VH3-23_IGHD4-23*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctacaactggttcgactactggggccaaggaaccctggtcaccgtctcctcagctagc

SEQ ID NO: 1689 - DNA, 380 bp, Artificial Sequence
  Description of Artificial Sequence: Synthetic polynucleotide
  gi|Fabrus|D01_VH3-23_IGHD4-23*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctacaactggttcgactactggggccaaggaaccctggtcaccgtctcctcagctagc

SEQ ID NO: 1690 - DNA, 383 bp, Artificial Sequence
  Description of Artificial Sequence: Synthetic polynucleotide
  gi|Fabrus|D02_VH3-23_IGHD5-5*01(2)>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctacaactggttcgactactggggccaaggaaccctggtcaccgtctcctcagctagc

SEQ ID NO: 1691 - DNA, 383 bp, Artificial Sequence
  Description of Artificial Sequence: Synthetic polynucleotide
  gi|Fabrus|D03_VH3-23_IGHD5-5*01(2)>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctacaactggttcgactactggggccaaggaaccctggtcaccgtctcctcagctagc

SEQ ID NO: 1692 - DNA, 386 bp, Artificial Sequence
  Description of Artificial Sequence: Synthetic polynucleotide
  gi|Fabrus|D04_VH3-23_IGHD5-12*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctacaactggttcgactactggggccaaggaaccctggtcaccgtctcctcagctagc

SEQ ID NO: 1693 - DNA, 386 bp, Artificial Sequence
  Description of Artificial Sequence: Synthetic polynucleotide
  gi|Fabrus|D05_VH3-23_IGHD5-12*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctacaactggttcgactactggggccaaggaaccctggtcaccgtctcctcagctagc

SEQ ID NO: 1694 - DNA, 383 bp, Artificial Sequence; identical to SEQ ID NO: 1690
  Description of Artificial Sequence: Synthetic polynucleotide
  gi|Fabrus|D06_VH3-23_IGHD5-18*01(2)>1'_IGHJ5*01

SEQ ID NO: 1695 - DNA, 383 bp, Artificial Sequence; identical to SEQ ID NO: 1691
  Description of Artificial Sequence: Synthetic polynucleotide
  gi|Fabrus|D07_VH3-23_IGHD5-18*01(2)>3'_IGHJ5*01

SEQ ID NO: 1696 - DNA, 383 bp, Artificial Sequence
  Description of Artificial Sequence: Synthetic polynucleotide
  gi|Fabrus|D08_VH3-23_IGHD5-24*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctacaactggttcgactactggggccaaggaaccctggtcaccgtctcctcagctagc

SEQ ID NO: 1697 - DNA, 383 bp, Artificial Sequence
  Description of Artificial Sequence: Synthetic polynucleotide
  gi|Fabrus|D09_VH3-23_IGHD5-24*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctacaactggttcgactactggggccaaggaaccctggtcaccgtctcctcagctagc

SEQ ID NO: 1698 - DNA, 380 bp, Artificial Sequence
  Description of Artificial Sequence: Synthetic polynucleotide
  gi|Fabrus|D10_VH3-23_IGHD6-6*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctacaactggttcgactactggggccaaggaaccctggtcaccgtctcctcagctagc

SEQ ID NO: 1699 - DNA, 380 bp, Artificial Sequence
  Description of Artificial Sequence: Synthetic polynucleotide
  gi|Fabrus|D11_VH3-23_IGHD6-6*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctacaactggttcgactactggggccaaggaaccctggtcaccgtctcctcagctagc

SEQ ID NO: 1700 - DNA, 380 bp, Artificial Sequence
  Description of Artificial Sequence: Synthetic polynucleotide
  gi|Fabrus|D12_VH3-23_IGHD6-6*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctacaactggttcgactactggggccaaggaaccctggtcaccgtctcctcagctagc

SEQ ID NO: 1701 - DNA, 383 bp, Artificial Sequence
  Description of Artificial Sequence: Synthetic polynucleotide
  gi|Fabrus|E01_VH3-23_IGHD6-13*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctacaactggttcgactactggggccaaggaaccctggtcaccgtctcctcagctagc

SEQ ID NO: 1702 - DNA, 383 bp, Artificial Sequence
  Description of Artificial Sequence: Synthetic polynucleotide
  gi|Fabrus|E02_VH3-23_IGHD6-13*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctacaactggttcgactactggggccaaggaaccctggtcaccgtctcctcagctagc

SEQ ID NO: 1703 - DNA, 383 bp, Artificial Sequence
  Description of Artificial Sequence: Synthetic polynucleotide
  gi|Fabrus|E03_VH3-23_IGHD6-13*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctacaactggttcgactactggggccaaggaaccctggtcaccgtctcctcagctagc

SEQ ID NO: 1704 - DNA, 383 bp, Artificial Sequence
  Description of Artificial Sequence: Synthetic polynucleotide
  gi|Fabrus|E04_VH3-23_IGHD6-19*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctacaactggttcgactactggggccaaggaaccctggtcaccgtctcctcagctagc

SEQ ID NO: 1705 - DNA, 383 bp, Artificial Sequence
  Description of Artificial Sequence: Synthetic polynucleotide
  gi|Fabrus|E05_VH3-23_IGHD6-19*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctacaactggttcgactactggggccaaggaaccctggtcaccgtctcctcagctagc

SEQ ID NO: 1706 - DNA, 383 bp, Artificial Sequence
  Description of Artificial Sequence: Synthetic polynucleotide
  gi|Fabrus|E06_VH3-23_IGHD6-19*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctacaactggttcgactactggggccaaggaaccctggtcaccgtctcctcagctagc

SEQ ID NO: 1707 - DNA, 380 bp, Artificial Sequence
  Description of Artificial Sequence: Synthetic polynucleotide
  gi|Fabrus|E07_VH3-23_IGHD6-25*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctacaactggttcgactactggggccaaggaaccctggtcaccgtctcctcagctagc

SEQ ID NO: 1708 - DNA, 380 bp, Artificial Sequence
  Description of Artificial Sequence: Synthetic polynucleotide
  gi|Fabrus|E08_VH3-23_IGHD6-25*01>3'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctacaactggttcgactactggggccaaggaaccctggtcaccgtctcctcagctagc

SEQ ID NO: 1709 - DNA, 374 bp, Artificial Sequence
  Description of Artificial Sequence: Synthetic polynucleotide
  gi|Fabrus|E09_VH3-23_IGHD7-27*01>1'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctacaactggttcgactactggggccaaggaaccctggtcaccgtctcctcagctagc

SEQ ID NO: 1710 - DNA, 374 bp, Artificial Sequence
  Description of Artificial Sequence: Synthetic polynucleotide
  gi|Fabrus|E10_VH3-23_IGHD7-27*01>2'_IGHJ5*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctacaactggttcgactactggggccaaggaaccctggtcaccgtctcctcagctagc

SEQ ID NO: 1711 - DNA, 392 bp, Artificial Sequence
  Description of Artificial Sequence: Synthetic polynucleotide
  gi|Fabrus|A01_VH3-23_IGHD1-1*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtacaactggaacgacgtcctattactactactactacggtatggacgtctggggccaaggaaccctggtcaccgtctcctcagctagc

SEQ ID NO: 1712 - DNA, 392 bp, Artificial Sequence
  Description of Artificial Sequence: Synthetic polynucleotide
  gi|Fabrus|A02_VH3-23_IGHD1-1*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtacaactggaacgacggtcctattactactactactacggtatggacgtctggggccaaggaaccctggtcaccgtctcctcagctagc

SEQ ID NO: 1713 - DNA, 392 bp, Artificial Sequence
  Description of Artificial Sequence: Synthetic polynucleotide
  gi|Fabrus|A03_VH3-23_IGHD1-1*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtacaactggaacgactcctattactactactactacggtatggacgtctggggccaaggaaccctggtcaccgtctcctcagctagc

SEQ ID NO: 1714 - DNA, 392 bp, Artificial Sequence
  Description of Artificial Sequence: Synthetic polynucleotide
  gi|Fabrus|A04_VH3-23_IGHD1-7*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaactacgtcctattactactactactacggtatggacgtctggggccaaggaaccctggtcaccgtctcctcagctagc

SEQ ID NO: 1715 - DNA, 392 bp, Artificial Sequence
  Description of Artificial Sequence: Synthetic polynucleotide
  gi|Fabrus|A05_VH3-23_IGHD1-7*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaactactcctattactactactactacggtatggacgtctggggccaaggaaccctggtcaccgtctcctcagctagc

SEQ ID NO: 1716 - DNA, 392 bp, Artificial Sequence
  Description of Artificial Sequence: Synthetic polynucleotide
  gi|Fabrus|A06_VH3-23_IGHD1-14*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataaccggaaccacgtcctattactactactactacggtatggacgtctggggccaaggaaccctggtcaccgtctcctcagctagc

SEQ ID NO: 1717 - DNA, 392 bp, Artificial Sequence
  Description of Artificial Sequence: Synthetic polynucleotide
  gi|Fabrus|A07_VH3-23_IGHD1-14*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataaccggaaccactcctattactactactactacggtatggacgtctggggccaaggaaccctggtcaccgtctcctcagctagc

SEQ ID NO: 1718 - DNA, 392 bp, Artificial Sequence
  Description of Artificial Sequence: Synthetic polynucleotide
  gi|Fabrus|A08_VH3-23_IGHD1-20*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataactggaacgacgtcctattactactactactacggtatggacgtctggggccaaggaaccctggtcaccgtctcctcagctagc

SEQ ID NO: 1719 - DNA, 392 bp, Artificial Sequence
  Description of Artificial Sequence: Synthetic polynucleotide
  gi|Fabrus|A09_VH3-23_IGHD1-20*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataactggaacgactcctattactactactactacggtatggacgtctggggccaaggaaccctggtcaccgtctcctcagctagc

SEQ ID NO: 1720 - DNA, 395 bp, Artificial Sequence
  Description of Artificial Sequence: Synthetic polynucleotide
  gi|Fabrus|A10_VH3-23_IGHD1-26*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagtgggagctactacgtcctattactactactactacggtatggacgtctggggccaaggaaccctggtcaccgtctcctcagctagc

SEQ ID NO: 1721 - DNA, 395 bp, Artificial Sequence
  Description of Artificial Sequence: Synthetic polynucleotide
  gi|Fabrus|A11_VH3-23_IGHD1-26*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagtgggagctactactcctattactactactactacggtatggacgtctggggccaaggaaccctggtcaccgtctcctcagctagc

SEQ ID NO: 1722 - DNA, 404 bp, Artificial Sequence
  Description of Artificial Sequence: Synthetic polynucleotide
  gi|Fabrus|A12_VH3-23_IGHD2-2*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtagtaccagctgctatgcctcctattactactactactacggtatggacgtctggggccaaggaaccctggtcaccgtctcctcagctagc

SEQ ID NO: 1723 - DNA, 404 bp, Artificial Sequence
  Description of Artificial Sequence: Synthetic polynucleotide
  gi|Fabrus|B01_VH3-23_IGHD2-2*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtagtaccagctgctatgtcctattactactactactacggtatggacgtctggggccaaggaaccctggtcaccgtctcctcagctagc

SEQ ID NO: 1724 - DNA, 404 bp, Artificial Sequence
  Description of Artificial Sequence: Synthetic polynucleotide
  gi|Fabrus|B02_VH3-23_IGHD2-8*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtactaatggtgtatgctatacctcctattactactactactacggtatggacgtctggggccaaggaaccctggtcaccgtctcctcagctagc

SEQ ID NO: 1725 - DNA, 404 bp, Artificial Sequence
  Description of Artificial Sequence: Synthetic polynucleotide
  gi|Fabrus|B03_VH3-23_IGHD2-8*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtactaatggtgtatgctatatcctattactactactactacggtatggacgtctggggccaaggaaccctggtcaccgtctcctcagctagc

SEQ ID NO: 1726 - DNA, 404 bp, Artificial Sequence
  Description of Artificial Sequence: Synthetic polynucleotide
  gi|Fabrus|B04_VH3-23_IGHD2-15*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggatattgtagtggtggtagctgctactcctcctattactactactactacggtatggacgtctggggccaaggaaccctggtcaccgtctcctcagctagc

SEQ ID NO: 1727 - DNA, 404 bp, Artificial Sequence
  Description of Artificial Sequence: Synthetic polynucleotide
  gi|Fabrus|B05_VH3-23_IGHD2-15*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagaggatattgtagtggtggtagctgctacttcctattactactactactacggtatggacgtctggggccaaggaaccctggtcaccgtctcctcagctagc

SEQ ID NO: 1728 - DNA, 401 bp, Artificial Sequence
  Description of Artificial Sequence: Synthetic polynucleotide
  gi|Fabrus|B06_VH3-23_IGHD2-21*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagcatattgtggtggtgattgctattcctcctattactactactactacggtatggacgtctggggccaaggaaccctggtcaccgtctcctcagctagc

SEQ ID NO: 1729 - DNA, 401 bp, Artificial Sequence
  Description of Artificial Sequence: Synthetic polynucleotide
  gi|Fabrus|B07_VH3-23_IGHD2-21*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagcatattgtggtggtgattgctatttcctattactactactactacggtatggacgtctggggccaaggaaccctggtcaccgtctcctcagctagc

SEQ ID NO: 1730 - DNA, 404 bp, Artificial Sequence
  Description of Artificial Sequence: Synthetic polynucleotide
  gi|Fabrus|B08_VH3-23_IGHD3-3*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtattacgatttttggagtggttattatactcctattactactactactacggtatggacgtctggggccaaggaaccctggtcaccgtctcctcagctagc

SEQ ID NO: 1731 - DNA, 404 bp, Artificial Sequence
  Description of Artificial Sequence: Synthetic polynucleotide
  gi|Fabrus|B09_VH3-23_IGHD3-3*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatttttggagtggttattatacctcctattactactactactacggtatggacgtctggggccaaggaaccctggtcaccgtctcctcagctagc

SEQ ID NO: 1732 - DNA, 404 bp, Artificial Sequence
  Description of Artificial Sequence: Synthetic polynucleotide
  gi|Fabrus|B10_VH3-23_IGHD3-3*01>3_IGHJ6*0
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattacgatttttggagtggttattatatcctattactactactactacggtatggacgtctggggccaaggaaccctggtcaccgtctcctcagctagc

SEQ ID NO: 1733 - DNA, 404 bp, Artificial Sequence
  Description of Artificial Sequence: Synthetic polynucleotide
  gi|Fabrus|B11_VH3-23_IGHD3-9*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattacgatattttgactggttattataactcctattactactactactacggtatggacgtctggggccaaggaaccctggtcaccgtctcctcagctagc

SEQ ID NO: 1734 - DNA, 404 bp, Artificial Sequence
  Description of Artificial Sequence: Synthetic polynucleotide
  gi|Fabrus|B12_VH3-23_IGHD3-10*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatggttcggggagttattataactcctattactactactactacggtatggacgtctggggccaaggaaccctggtcaccgtctcctcagctagc

SEQ ID NO: 1735 - DNA, 404 bp, Artificial Sequence
  Description of Artificial Sequence: Synthetic polynucleotide
  gi|Fabrus|C01_VH3-23_IGHD3-10*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatggttcggggagttattatatcctattactactactactacggtatggacgtctggggccaaggaaccctggtcaccgtctcctcagctagc

SEQ ID NO: 1736 - DNA, 410 bp, Artificial Sequence
  Description of Artificial Sequence: Synthetic polynucleotide
  gi|Fabrus|C02_VH3-23_IGHD3-16*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattatgattacgtttgggggagttatgcttatacctcctattactactactactacggtatggacgtctggggccaaggaaccctggtcaccgtctcctcagctagc

SEQ ID NO: 1737 - DNA, 410 bp, Artificial Sequence
  Description of Artificial Sequence: Synthetic polynucleotide
  gi|Fabrus|C03_VH3-23_IGHD3-16*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattatgattacgtttgggggagttatgcttatatcctattactactactactacggtatggacgtctggggccaaggaaccctggtcaccgtctcctcagctagc

SEQ ID NO: 1738 - DNA, 404 bp, Artificial Sequence
  Description of Artificial Sequence: Synthetic polynucleotide
  gi|Fabrus|C04_VH3-23_IGHD3-22*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatattactatgatagtagtggttattactactcctattactactactactacggtatggacgtctggggccaaggaaccctggtcaccgtctcctcagctagc

SEQ ID NO: 1739 - DNA, 404 bp, Artificial Sequence
  Description of Artificial Sequence: Synthetic polynucleotide
  gi|Fabrus|C05_VH3-23_IGHD3-22*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtattactatgatagtagtggttattacttcctattactactactactacggtatggacgtctggggccaaggaaccctggtcaccgtctcctcagctagc

SEQ ID NO: 1740 - DNA, 389 bp, Artificial Sequence
  Description of Artificial Sequence: Synthetic polynucleotide
  gi|Fabrus|C06_VH3-23_IGHD4-4*01(1)>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacagtaactactcctattactactactactacggtatggacgtctggggccaaggaaccctggtcaccgtctcctcagctagc

SEQ ID NO: 1741 - DNA, 389 bp, Artificial Sequence
  Description of Artificial Sequence: Synthetic polynucleotide
  gi|Fabrus|C07_VH3-23_IGHD4-4*01(1)>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacagtaacttcctattactactactactacggtatggacgtctggggccaaggaaccctggtcaccgtctcctcagctagc

SEQ ID NO: 1742 - DNA, 389 bp, Artificial Sequence; identical to SEQ ID NO: 1740
  Description of Artificial Sequence: Synthetic polynucleotide
  gi|Fabrus|C08_VH3-23_IGHD4-11*01(1)>2_IGHJ6*01

SEQ ID NO: 1743 - DNA, 389 bp, Artificial Sequence; identical to SEQ ID NO: 1741
  Description of Artificial Sequence: Synthetic polynucleotide
  gi|Fabrus|C09_VH3-23_IGHD4-11*01(1)>3_IGHJ6*01

SEQ ID NO: 1744 - DNA, 389 bp, Artificial Sequence
  Description of Artificial Sequence: Synthetic polynucleotide
  gi|Fabrus|C10_VH3-23_IGHD4-17*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtgactactcctattactactactactacggtatggacgtctggggccaaggaaccctggtcaccgtctcctcagctagc

SEQ ID NO: 1745 - DNA, 389 bp, Artificial Sequence
  Description of Artificial Sequence: Synthetic polynucleotide
  gi|Fabrus|C11_VH3-23_IGHD4-17*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtgacttcctattactactactactacggtatggacgtctggggccaaggaaccctggtcaccgtctcctcagctagc

SEQ ID NO: 1746 - DNA, 392 bp, Artificial Sequence
  Description of Artificial Sequence: Synthetic polynucleotide
  gi|Fabrus|C12_VH3-23_IGHD4-23*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagactacggtggtaactcctcctattactactactactacggtatggacgtctggggccaaggaaccctggtcaccgtctcctcagctagc

SEQ ID NO: 1747 - DNA, 392 bp, Artificial Sequence
  Description of Artificial Sequence: Synthetic polynucleotide
  gi|Fabrus|D01_VH3-23_IGHD4-23*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtgactacggtggtaacttcctattactactactactacggtatggacgtctggggccaaggaaccctggtcaccgtctcctcagctagc

SEQ ID NO: 1748 - DNA, 395 bp, Artificial Sequence
  Description of Artificial Sequence: Synthetic polynucleotide
  gi|Fabrus|D02_VH3-23_IGHD5-5*01(2)>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatacagctatggttacgtcctattactactactactacggtatggacgtctggggccaaggaaccctggtcaccgtctcctcagctagc

SEQ ID NO: 1749 - DNA, 395 bp, Artificial Sequence
  Description of Artificial Sequence: Synthetic polynucleotide
  gi|Fabrus|D03_VH3-23_IGHD5-5*01(2)>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggatacagctatggttacggtcctattactactactactacggtatggacgtctggggccaaggaaccctggtcaccgtctcctcagctagc

SEQ ID NO: 1750 - DNA, 395 bp, Artificial Sequence
  Description of Artificial Sequence: Synthetic polynucleotide
  gi|Fabrus|D04_VH3-23_IGHD5-5*01(2)>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatacagctatggttactcctattactactactactacggtatggacgtctggggccaaggaaccctggtcaccgtctcctcagctagc

SEQ ID NO: 1751 - DNA, 398 bp, Artificial Sequence
  Description of Artificial Sequence: Synthetic polynucleotide
  gi|Fabrus|D05_VH3-23_IGHD5-12*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggatatagtggctacgattacgtcctattactactactactacggtatggacgtctggggccaaggaaccctggtcaccgtctcctcagctagc

SEQ ID NO: 1752 - DNA, 398 bp, Artificial Sequence
  Description of Artificial Sequence: Synthetic polynucleotide
  gi|Fabrus|D06_VH3-23_IGHD5-12*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggatatagtggctacgattactcctattactactactactacggtatggacgtctggggccaaggaaccctggtcaccgtctcctcagctagc

SEQ ID NO: 1753 - DNA, 395 bp, Artificial Sequence; identical to SEQ ID NO: 1748
  Description of Artificial Sequence: Synthetic polynucleotide
  gi|Fabrus|D07_VH3-23_IGHD5-18*01(2)>1_IGHJ6*01

SEQ ID NO: 1754 - DNA, 395 bp, Artificial Sequence; identical to SEQ ID NO: 1749
  Description of Artificial Sequence: Synthetic polynucleotide
  gi|Fabrus|D08_VH3-23_IGHD5-18*01(2)>2_IGHJ6*01

SEQ ID NO: 1755 - DNA, 395 bp, Artificial Sequence; identical to SEQ ID NO: 1750
  Description of Artificial Sequence: Synthetic polynucleotide
  gi|Fabrus|D09_VH3-23_IGHD5-18*01(2)>3_IGHJ6*01

SEQ ID NO: 1756 - DNA, 395 bp, Artificial Sequence
  Description of Artificial Sequence: Synthetic polynucleotide
  gi|Fabrus|D10_VH3-23_IGHD5-24*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagagatggctacaattacgtcctattactactactactacggtatggacgtctggggccaaggaaccctggtcaccgtctcctcagctagc

SEQ ID NO: 1757 - DNA, 395 bp, Artificial Sequence
  Description of Artificial Sequence: Synthetic polynucleotide
  gi|Fabrus|D11_VH3-23_IGHD5-24*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagagatggctacaattactcctattactactactactacggtatggacgtctggggccaaggaaccctggtcaccgtctcctcagctagc

SEQ ID NO: 1758 - DNA, 392 bp, Artificial Sequence
  Description of Artificial Sequence: Synthetic polynucleotide
  gi|Fabrus|D12_VH3-23_IGHD6-6*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagagtatagcagctcgtcctcctattactactactactacggtatggacgtctggggccaaggaaccctggtcaccgtctcctcagctagc

SEQ ID NO: 1759 - DNA, 392 bp, Artificial Sequence
  Description of Artificial Sequence: Synthetic polynucleotide
  gi|Fabrus|E01_VH3-23_IGHD6-6*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaagtatagcagctcgtccgtcctattactactactactacggtatggacgtctggggccaaggaaccctggtcaccgtctcctcagctagc

SEQ ID NO: 1760 - DNA, 395 bp, Artificial Sequence
  Description of Artificial Sequence: Synthetic polynucleotide
  gi|Fabrus|E02_VH3-23_IGHD6-13*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcagctggtactcctattactactactactacggtatggacgtctggggccaaggaaccctggtcaccgtctcctcagctagc

SEQ ID NO: 1761 - DNA, 395 bp, Artificial Sequence
  Description of Artificial Sequence: Synthetic polynucleotide
  gi|Fabrus|E03_VH3-23_IGHD6-13*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcagctggtacgtcctattactactactactacggtatggacgtctggggccaaggaaccctggtcaccgtctcctcagctagc

SEQ ID NO: 1762 - DNA, 395 bp, Artificial Sequence
  Description of Artificial Sequence: Synthetic polynucleotide
  gi|Fabrus|E04_VH3-23_IGHD6-19*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagtggctggtactcctattactactactactacggtatggacgtctggggccaaggaaccctggtcaccgtctcctcagctagc

SEQ ID NO: 1763 - DNA, 395 bp, Artificial Sequence
  Description of Artificial Sequence: Synthetic polynucleotide
  gi|Fabrus|E05_VH3-23_IGHD6-19*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagtggctggtacgtcctattactactactactacggtatggacgtctggggccaaggaaccctggtcaccgtctcctcagctagc

SEQ ID NO: 1764 - DNA, 392 bp, Artificial Sequence
  Description of Artificial Sequence: Synthetic polynucleotide
  gi|Fabrus|E06_VH3-23_IGHD6-25*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtatagcagcggctactcctattactactactactacggtatggacgtctggggccaaggaaccctggtcaccgtctcctcagctagc

SEQ ID NO: 1765 - DNA, 392 bp, Artificial Sequence
  Description of Artificial Sequence: Synthetic polynucleotide
  gi|Fabrus|E07_VH3-23_IGHD6-25*01>2_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcagcggctacgtcctattactactactactacggtatggacgtctggggccaaggaaccctggtcaccgtctcctcagctagc

SEQ ID NO: 1766 - DNA, 386 bp, Artificial Sequence
  Description of Artificial Sequence: Synthetic polynucleotide
  gi|Fabrus|E08_VH3-23_IGHD7-27*01>1_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaactaactggggagtcctattactactactactacggtatggacgtctggggccaaggaaccctggtcaccgtctcctcagctagc

SEQ ID NO: 1767 - DNA, 386 bp, Artificial Sequence
  Description of Artificial Sequence: Synthetic polynucleotide
  gi|Fabrus|E09_VH3-23_IGHD7-27*01>3_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagctaactggggatcctattactactactactacggtatggacgtctggggccaaggaaccctggtcaccgtctcctcagctagc

SEQ ID NO: 1768 - DNA, 392 bp, Artificial Sequence
  Description of Artificial Sequence: Synthetic polynucleotide
  gi|Fabrus|A01_VH3-23_IGHD1-1*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttgtaccgtcctattactactactactacggtatggacgtctggggccaaggaaccctggtcaccgtctcctcagctagc

SEQ ID NO: 1769 - DNA, 392 bp, Artificial Sequence
  Description of Artificial Sequence: Synthetic polynucleotide
  gi|Fabrus|A02_VH3-23_IGHD1-1*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttgtaccggtcctattactactactactacggtatggacgtctggggccaaggaaccctggtcaccgtctcctcagctagc

SEQ ID NO: 1770 - DNA, 392 bp, Artificial Sequence
  Description of Artificial Sequence: Synthetic polynucleotide
  gi|Fabrus|A03_VH3-23_IGHD1-1*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttgtacctcctattactactactactacggtatggacgtctggggccaaggaaccctggtcaccgtctcctcagctagc

SEQ ID NO: 1771 - DNA, 392 bp, Artificial Sequence
  Description of Artificial Sequence: Synthetic polynucleotide
  gi|Fabrus|A04_VH3-23_IGHD1-7*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttccagttataccgtcctattactactactactacggtatggacgtctggggccaaggaaccctggtcaccgtctcctcagctagc

SEQ ID NO: 1772 - DNA, 392 bp, Artificial Sequence
  Description of Artificial Sequence: Synthetic polynucleotide
  gi|Fabrus|A05_VH3-23_IGHD1-7*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttccagttatacctcctattactactactactacggtatggacgtctggggccaaggaaccctggtcaccgtctcctcagctagc

SEQ ID NO: 1773 - DNA, 392 bp, Artificial Sequence
  Description of Artificial Sequence: Synthetic polynucleotide
  gi|Fabrus|A06_VH3-23_IGHD1-14*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtggttccggttataccgtcctattactactactactacggtatggacgtctggggccaaggaaccctggtcaccgtctcctcagctagc

SEQ ID NO: 1774 - DNA, 392 bp, Artificial Sequence
  Description of Artificial Sequence: Synthetic polynucleotide
  gi|Fabrus|A07_VH3-23_IGHD1-14*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatggttccggttataccggtcctattactactactactacggtatggacgtctggggccaaggaaccctggtcaccgtctcctcagctagc

SEQ ID NO: 1775 - DNA, 392 bp, Artificial Sequence
  Description of Artificial Sequence: Synthetic polynucleotide
  gi|Fabrus|A08_VH3-23_IGHD1-14*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtggttccggttatacctcctattactactactactacggtatggacgtctggggccaaggaaccctggtcaccgtctcctcagctagc

SEQ ID NO: 1776 - DNA, 392 bp, Artificial Sequence
  Description of Artificial Sequence: Synthetic polynucleotide
  gi|Fabrus|A09_VH3-23_IGHD1-20*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtcgttccagttataccgtcctattactactactactacggtatggacgtctggggccaaggaaccctggtcaccgtctcctcagctagc

SEQ ID NO: 1777 - DNA, 392 bp, Artificial Sequence
  Description of Artificial Sequence: Synthetic polynucleotide
  gi|Fabrus|A10_VH3-23_IGHD1-20*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatcgttccagttataccggtcctattactactactactacggtatggacgtctggggccaaggaaccctggtcaccgtctcctcagctagc

SEQ ID NO: 1778 - DNA, 392 bp, Artificial Sequence
  Description of Artificial Sequence: Synthetic polynucleotide
  gi|Fabrus|A11_VH3-23_IGHD1-20*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtcgttccagttatacctcctattactactactactacggtatggacgtctggggccaaggaaccctggtcaccgtctcctcagctagc

SEQ ID NO: 1779 - DNA, 395 bp, Artificial Sequence
  Description of Artificial Sequence: Synthetic polynucleotide
  gi|Fabrus|A12_VH3-23_IGHD1-26*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtagctcccactataccgtcctattactactactactacggtatggacgtctggggccaaggaaccctggtcaccgtctcctcagctagc

SEQ ID NO: 1780 - DNA, 395 bp, Artificial Sequence
  Description of Artificial Sequence: Synthetic polynucleotide
  gi|Fabrus|B01_VH3-23_IGHD1-26*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtagctcccactatacctcctattactactactactacggtatggacgtctggggccaaggaaccctggtcaccgtctcctcagctagc

SEQ ID NO: 1781 - DNA, 404 bp, Artificial Sequence
  Description of Artificial Sequence: Synthetic polynucleotide
  gi|Fabrus|B02_VH3-23_IGHD2-2*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggcatagcagctggtactactacaatatcctcctattactactactactacggtatggacgtctggggccaaggaaccctggtcaccgtctcctcagctagc

SEQ ID NO: 1782 - DNA, 404 bp, Artificial Sequence
  Description of Artificial Sequence: Synthetic polynucleotide
  gi|Fabrus|B03_VH3-23_IGHD2-2*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggcatagcagctggtactactacaatatctcctattactactactactacggtatggacgtctggggccaaggaaccctggtcaccgtctcctcagctagc

SEQ ID NO: 1783 - DNA, 404 bp, Artificial Sequence
  Description of Artificial Sequence: Synthetic polynucleotide
  gi|Fabrus|B04_VH3-23_IGHD2-8*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtatagcatacaccattagtacaatatcctcctattactactactactacggtatggacgtctggggccaaggaaccctggtcaccgtctcctcagctagc

SEQ ID NO: 1784 - DNA, 404 bp, Artificial Sequence
  Description of Artificial Sequence: Synthetic polynucleotide
  gi|Fabrus|B05_VH3-23_IGHD2-15*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagtagcagctaccaccactacaatatcctcctattactactactactacggtatggacgtctggggccaaggaaccctggtcaccgtctcctcagctagc

SEQ ID NO: 1785 - DNA, 404 bp, Artificial Sequence
  Description of Artificial Sequence: Synthetic polynucleotide
  gi|Fabrus|B06_VH3-23_IGHD2-15*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagtagcagctaccaccactacaatatctcctattactactactactacggtatggacgtctggggccaaggaaccctggtcaccgtctcctcagctagc

SEQ ID NO: 1786 - DNA, 401 bp, Artificial Sequence
  Description of Artificial Sequence: Synthetic polynucleotide
  gi|Fabrus|B07_VH3-23_IGHD2-21*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggaatagcaatcaccaccacaatatgctcctattactactactactacggtatggacgtctggggccaaggaaccctggtcaccgtctcctcagctagc

SEQ ID NO: 1787 - DNA, 401 bp, Artificial Sequence
  Description of Artificial Sequence: Synthetic polynucleotide
  gi|Fabrus|B08_VH3-23_IGHD2-21*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggaatagcaatcaccaccacaatatgtcctattactactactactacggtatggacgtctggggccaaggaaccctggtcaccgtctcctcagctagc

SEQ ID NO: 1788 - DNA, 404 bp, Artificial Sequence
  Description of Artificial Sequence: Synthetic polynucleotide
  gi|Fabrus|B09_VH3-23_IGHD3-3*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataataaccactccaaaaatcgtaatatcctattactactactactacggtatggacgtctggggccaaggaaccctggtcaccgtctcctcagctagc

SEQ ID NO: 1789 - DNA, 404 bp, Artificial Sequence
  Description of Artificial Sequence: Synthetic polynucleotide
  gi|Fabrus|B10_VH3-23_IGHD3-3*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataataaccactccaaaaatcgtaattcctattactactactactacggtatggacgtctggggccaaggaaccctggtcaccgtctcctcagctagc

SEQ ID NO: 1790 - DNA, 404 bp, Artificial Sequence
  Description of Artificial Sequence: Synthetic polynucleotide
  gi|Fabrus|B11_VH3-23_IGHD3-9*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataaccagtcaaaatatcgtaatatcctattactactactactacggtatggacgtctggggccaaggaaccctggtcaccgtctcctcagctagc

SEQ ID NO: 1791 - DNA, 404 bp, Artificial Sequence
  Description of Artificial Sequence: Synthetic polynucleotide
  gi|Fabrus|B12_VH3-23_IGHD3-9*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataaccagtcaaaatatcgtaattcctattactactactactacggtatggacgtctggggccaaggaaccctggtcaccgtctcctcagctagc

SEQ ID NO: 1792 - DNA, 404 bp, Artificial Sequence
  Description of Artificial Sequence: Synthetic polynucleotide
  gi|Fabrus|C01_VH3-23_IGHD3-10*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagttataataactccccgaaccatagtaatatcctattactactactactacggtatggacgtctggggccaaggaaccctggtcaccgtctcctcagctagc

SEQ ID NO: 1793 - DNA, 404 bp, Artificial Sequence
  Description of Artificial Sequence: Synthetic polynucleotide
  gi|Fabrus|C02_VH3-23_IGHD3-10*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggttataataactccccgaaccatagtaattcctattactactactactacggtatggacgtctggggccaaggaaccctggtcaccgtctcctcagctagc

SEQ ID NO: 1794 - DNA, 410 bp, Artificial Sequence
  Description of Artificial Sequence: Synthetic polynucleotide
  gi|Fabrus|C03_VH3-23_IGHD3-16*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtataagcataactcccccaaacgtaatcataatatcctattactactactactacggtatggacgtctggggccaaggaaccctggtcaccgtctcctcagctagc

SEQ ID NO: 1795 - DNA, 410 bp, Artificial Sequence
  Description of Artificial Sequence: Synthetic polynucleotide
  gi|Fabrus|C04_VH3-23_IGHD3-16*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggtataagcataactcccccaaacgtaatcataattcctattactactactactacggtatggacgtctggggccaaggaaccctggtcaccgtctcctcagctagc

SEQ ID NO: 1796 - DNA, 404 bp, Artificial Sequence
  Description of Artificial Sequence: Synthetic polynucleotide
  gi|Fabrus|C05_VH3-23_IGHD3-22*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtaataaccactactatcatagtaatatcctattactactactactacggtatggacgtctggggccaaggaaccctggtcaccgtctcctcagctagc

SEQ ID NO: 1797 - DNA, 389 bp, Artificial Sequence
  Description of Artificial Sequence: Synthetic polynucleotide
  gi|Fabrus|C06_VH3-23_IGHD4-4*01(1)>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagttactgtagtctcctattactactactactacggtatggacgtctggggccaaggaaccctggtcaccgtctcctcagctagc

SEQ ID NO: 1798 - DNA, 389 bp, Artificial Sequence
  Description of Artificial Sequence: Synthetic polynucleotide
  gi|Fabrus|C07_VH3-23_IGHD4-4*01(1)>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagttactgtagttcctattactactactactacggtatggacgtctggggccaaggaaccctggtcaccgtctcctcagctagc

SEQ ID NO: 1799 - DNA, 389 bp, Artificial Sequence; identical to SEQ ID NO: 1797
  Description of Artificial Sequence: Synthetic polynucleotide
  gi|Fabrus|C08_VH3-23_IGHD4-11*01(1)>1'_IGHJ6*01

SEQ ID NO: 1800 - DNA, 389 bp, Artificial Sequence; identical to SEQ ID NO: 1798
  Description of Artificial Sequence: Synthetic polynucleotide
  gi|Fabrus|C09_VH3-23_IGHD4-11*01(1)>3'_IGHJ6*01

SEQ ID NO: 1801 - DNA, 389 bp, Artificial Sequence
  Description of Artificial Sequence: Synthetic polynucleotide
  gi|Fabrus|C10_VH3-23_IGHD4-17*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagtcaccgtagtctcctattactactactactacggtatggacgtctggggccaaggaaccctggtcaccgtctcctcagctagc

SEQ ID NO: 1802 - DNA, 389 bp, Artificial Sequence
  Description of Artificial Sequence: Synthetic polynucleotide
  gi|Fabrus|C11_VH3-23_IGHD4-17*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagtcaccgtagttcctattactactactactacggtatggacgtctggggccaaggaaccctggtcaccgtctcctcagctagc

SEQ ID NO: 1803 - DNA, 392 bp, Artificial Sequence
  Description of Artificial Sequence: Synthetic polynucleotide
  gi|Fabrus|C12_VH3-23_IGHD4-23*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggagttaccaccgtagtctcctattactactactactacggtatggacgtctggggccaaggaaccctggtcaccgtctcctcagctagc

SEQ ID NO: 1804 - DNA, 392 bp, Artificial Sequence
  Description of Artificial Sequence: Synthetic polynucleotide
  gi|Fabrus|D01_VH3-23_IGHD4-23*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggagttaccaccgtagttcctattactactactactacggtatggacgtctggggccaaggaaccctggtcaccgtctcctcagctagc

SEQ ID NO: 1805 - DNA, 395 bp, Artificial Sequence
  Description of Artificial Sequence: Synthetic polynucleotide
  gi|Fabrus|D02_VH3-23_IGHD5-5*01(2)>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaaccatagctgtatccacgtcctattactactactactacggtatggacgtctggggccaaggaaccctggtcaccgtctcctcagctagc

SEQ ID NO: 1806 - DNA, 395 bp, Artificial Sequence
  Description of Artificial Sequence: Synthetic polynucleotide
  gi|Fabrus|D03_VH3-23_IGHD5-5*01(2)>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaaccatagctgtatccactcctattactactactactacggtatggacgtctggggccaaggaaccctggtcaccgtctcctcagctagc

SEQ ID NO: 1807 - DNA, 398 bp, Artificial Sequence
  Description of Artificial Sequence: Synthetic polynucleotide
  gi|Fabrus|D04_VH3-23_IGHD5-12*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaatcgtagccactatatccacgtcctattactactactactacggtatggacgtctggggccaaggaaccctggtcaccgtctcctcagctagc

SEQ ID NO: 1808 - DNA, 398 bp, Artificial Sequence
  Description of Artificial Sequence: Synthetic polynucleotide
  gi|Fabrus|D05_VH3-23_IGHD5-12*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaatcgtagccactatatccactcctattactactactactacggtatggacgtctggggccaaggaaccctggtcaccgtctcctcagctagc

SEQ ID NO: 1809 - DNA, 395 bp, Artificial Sequence; identical to SEQ ID NO: 1805
  Description of Artificial Sequence: Synthetic polynucleotide
  gi|Fabrus|D06_VH3-23_IGHD5-18*01(2)>1'_IGHJ6*01

SEQ ID NO: 1810 - DNA, 395 bp, Artificial Sequence; identical to SEQ ID NO: 1806
  Description of Artificial Sequence: Synthetic polynucleotide
  gi|Fabrus|D07_VH3-23_IGHD5-18*01(2)>3'_IGHJ6*01

SEQ ID NO: 1811 - DNA, 395 bp, Artificial Sequence
  Description of Artificial Sequence: Synthetic polynucleotide
  gi|Fabrus|D08_VH3-23_IGHD5-24*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaattgtagccatctctacgtcctattactactactactacggtatggacgtctggggccaaggaaccctggtcaccgtctcctcagctagc

SEQ ID NO: 1812 - DNA, 395 bp, Artificial Sequence
  Description of Artificial Sequence: Synthetic polynucleotide
  gi|Fabrus|D09_VH3-23_IGHD5-24*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaattgtagccatctctactcctattactactactactacggtatggacgtctggggccaaggaaccctggtcaccgtctcctcagctagc

SEQ ID NO: 1813 - DNA, 392 bp, Artificial Sequence
  Description of Artificial Sequence: Synthetic polynucleotide
  gi|Fabrus|D10_VH3-23_IGHD6-6*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggacgagctgctatactctcctattactactactactacggtatggacgtctggggccaaggaaccctggtcaccgtctcctcagctagc

SEQ ID NO: 1814 - DNA, 392 bp, Artificial Sequence
  Description of Artificial Sequence: Synthetic polynucleotide
  gi|Fabrus|D11_VH3-23_IGHD6-6*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagacgagctgctatactcgtcctattactactactactacggtatggacgtctggggccaaggaaccctggtcaccgtctcctcagctagc

SEQ ID NO: 1815 - DNA, 392 bp, Artificial Sequence
  Description of Artificial Sequence: Synthetic polynucleotide
  gi|Fabrus|D12_VH3-23_IGHD6-6*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagggacgagctgctatacttcctattactactactactacggtatggacgtctggggccaaggaaccctggtcaccgtctcctcagctagc

SEQ ID NO: 1816 - DNA, 395 bp, Artificial Sequence
  Description of Artificial Sequence: Synthetic polynucleotide
  gi|Fabrus|E01_VH3-23_IGHD6-13*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagctgctgctataccctcctattactactactactacggtatggacgtctggggccaaggaaccctggtcaccgtctcctcagctagc

SEQ ID NO: 1817 - DNA, 395 bp, Artificial Sequence
  Description of Artificial Sequence: Synthetic polynucleotide
  gi|Fabrus|E02_VH3-23_IGHD6-13*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagctgctgctatacccgtcctattactactactactacggtatggacgtctggggccaaggaaccctggtcaccgtctcctcagctagc

SEQ ID NO: 1818 - DNA, 395 bp, Artificial Sequence
  Description of Artificial Sequence: Synthetic polynucleotide
  gi|Fabrus|E03_VH3-23_IGHD6-13*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagctgctgctatacctcctattactactactactacggtatggacgtctggggccaaggaaccctggtcaccgtctcctcagctagc

SEQ ID NO: 1819 - DNA, 395 bp, Artificial Sequence
  Description of Artificial Sequence: Synthetic polynucleotide
  gi|Fabrus|E04_VH3-23_IGHD6-19*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtaccagccactgctataccctcctattactactactactacggtatggacgtctggggccaaggaaccctggtcaccgtctcctcagctagc

SEQ ID NO: 1820 - DNA, 395 bp, Artificial Sequence
  Description of Artificial Sequence: Synthetic polynucleotide
  gi|Fabrus|E05_VH3-23_IGHD6-19*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaataccagccactgctatacccgtcctattactactactactacggtatggacgtctggggccaaggaaccctggtcaccgtctcctcagctagc

SEQ ID NO: 1821 - DNA, 395 bp, Artificial Sequence
  Description of Artificial Sequence: Synthetic polynucleotide
  gi|Fabrus|E06_VH3-23_IGHD6-19*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtaccagccactgctatacctcctattactactactactacggtatggacgtctggggccaaggaaccctggtcaccgtctcctcagctagc

SEQ ID NO: 1822 - DNA, 392 bp, Artificial Sequence
  Description of Artificial Sequence: Synthetic polynucleotide
  gi|Fabrus|E07_VH3-23_IGHD6-25*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaagtagccgctgctataccctcctattactactactactacggtatggacgtctggggccaaggaaccctggtcaccgtctcctcagctagc

SEQ ID NO: 1823 - DNA, 392 bp, Artificial Sequence
  Description of Artificial Sequence: Synthetic polynucleotide
  gi|Fabrus|E08_VH3-23_IGHD6-25*01>3'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaggtagccgctgctatacctcctattactactactactacggtatggacgtctggggccaaggaaccctggtcaccgtctcctcagctagc

SEQ ID NO: 1824 - DNA, 386 bp, Artificial Sequence
  Description of Artificial Sequence: Synthetic polynucleotide
  gi|Fabrus|E09_VH3-23_IGHD7-27*01>1'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaatccccagttaggtcctattactactactactacggtatggacgtctggggccaaggaaccctggtcaccgtctcctcagctagc

SEQ ID NO: 1825 - DNA, 386 bp, Artificial Sequence
  Description of Artificial Sequence: Synthetic polynucleotide
  gi|Fabrus|E10_VH3-23_IGHD7-27*01>2'_IGHJ6*01
ccatggcagaggtgcagctgttggagtctgggggaggcttggtacagcctggggggtccctgagactctcctgtgcagcctctggattcacctttagcagctatgccatgagctgggtccgccaggctccagggaaggggctggagtgggtgagctctattagtggtagtggtggtagcacatactacgcagactccgtgaagggccggttcaccatctcacgtgacaattccaagaacacgctgtatctgcaaatgaacagcctgagagccgaggacacggccgtatattactgtgcgaaaccccagttagggtcctattactactactactacggtatggacgtctggggccaaggaaccctggtcaccgtctcctcagctagc

SEQ ID NO: 1826 - protein, 122 aa, Artificial Sequence
  Description of Artificial Sequence: Synthetic polypeptide
  gnl|Fabrus|HerceptinHC Protein
KVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSAS

SEQ ID NO: 1827 - protein, 121 aa, Artificial Sequence
  Description of Artificial Sequence: Synthetic polypeptide
  gnl|Fabrus|Anti-CD20 HC Protein
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVS

SEQ ID NO: 1828 - protein, 122 aa, Artificial Sequence
  Description of Artificial Sequence: Synthetic polypeptide
  gnl|Fabrus|VH1-18_IGHD1-26*01_IGHJ2*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGYSGSYYYWYFDLWGRGTLVTVSS

SEQ ID NO: 1829 - protein, 125 aa, Artificial Sequence
  Description of Artificial Sequence: Synthetic polypeptide
  gnl|Fabrus|VH1-18_IGHD2-21*01_IGHJ2*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREAYCGGDCYSYWYFDLWGRGTLVTVSS

SEQ ID NO: 1830 - protein, 132 aa, Artificial Sequence
  Description of Artificial Sequence: Synthetic polypeptide
  gnl|Fabrus|VH1-18_IGHD3-16*01_IGHJ6*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREYYDYVWGSYAYTDYYYYYGMDVWGQGTTVTVSS

SEQ ID NO: 1831 - protein, 125 aa, Artificial Sequence
  Description of Artificial Sequence: Synthetic polypeptide
  gnl|Fabrus|VH1-18_IGHD3-22*01_IGHJ4*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREYYYDSSGYYYDYFDYWGQGTLVTVSS

SEQ ID NO: 1832 - protein, 122 aa, Artificial Sequence
  Description of Artificial Sequence: Synthetic polypeptide
  gnl|Fabrus|VH1-18_IGHD4-23*01_IGHJ1*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDDYGGNSAEYFQHWGQGTLVTVSS

SEQ ID NO: 1833 - protein, 122 aa, Artificial Sequence
  Description of Artificial Sequence: Synthetic polypeptide
  gnl|Fabrus|VH1-18_IGHD5-12*01_IGHJ4*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGYSGYDYDYFDYWGQGTLVTVSS

SEQ ID NO: 1834 - protein, 122 aa, Artificial Sequence
  Description of Artificial Sequence: Synthetic polypeptide
  gnl|Fabrus|VH1-18_IGHD6-6*01_IGHJ1*01 Protein
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREEYSSSSAEYFQHWGQGTLVTVSS

SEQ ID NO: 1835 - protein, 120 aa, Artificial Sequence
  Description of Artificial Sequence: Synthetic polypeptide
  gnl|Fabrus|VH1-2_IGHD1-1*01_IGHJ3*01 Protein
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGYNWNDDAFDVWGQGTMVTVSS

SEQ ID NO: 1836 - protein, 120 aa, Artificial Sequence
  Description of Artificial Sequence: Synthetic polypeptide
  gnl|Fabrus|VH1-24_IGHD1-7*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGYNWNYDYFDYWGQGTLVTVSS

SEQ ID NO: 1837 - protein, 126 aa, Artificial Sequence
  Description of Artificial Sequence: Synthetic polypeptide
  gnl|Fabrus|VH1-24_IGHD2-15*01_IGHJ2*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEGYCSGGSCYSYWYFDLWGRGTLVTVSS

SEQ ID NO: 1838 - protein, 125 aa, Artificial Sequence
  Description of Artificial Sequence: Synthetic polypeptide
  gnl|Fabrus|VH1-24_IGHD3-10*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEYYYGSGSYYNDYFDYWGQGTLVTVSS

SEQ ID NO: 1839 - protein, 127 aa, Artificial Sequence
  Description of Artificial Sequence: Synthetic polypeptide
  gnl|Fabrus|VH1-24_IGHD3-16*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEYYDYVWGSYAYTDYFDYWGQGTLVTVSS

SEQ ID NO: 1840 - protein, 122 aa, Artificial Sequence
  Description of Artificial Sequence: Synthetic polypeptide
  gnl|Fabrus|VH1-24_IGHD3-16*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDDYGGNSYWYFDLWGRGTLVTVSS

SEQ ID NO: 1841 - protein, 122 aa, Artificial Sequence
  Description of Artificial Sequence: Synthetic polypeptide
  gnl|Fabrus|VH1-24_IGHD5-12*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSGYDYDYFDYWGQGTLVTVSS

SEQ ID NO: 1842 - protein, 126 aa, Artificial Sequence
  Description of Artificial Sequence: Synthetic polypeptide
  gnl|Fabrus|VH1-24_IGHD5-18*01_IGHJ6*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGGYSYGYDYYYYYGMDVWGQGTTVTVSS

SEQ ID NO: 1843 - protein, 122 aa, Artificial Sequence
  Description of Artificial Sequence: Synthetic polypeptide
  gnl|Fabrus|VH1-24_IGHD6-19*01_IGHJ4*01 Protein
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEGYSSGWYDYFDYWGQGTLVTVSS

SEQ ID NO: 1844 - protein, 126 aa, Artificial Sequence
  Description of Artificial Sequence: Synthetic polypeptide
  gnl|Fabrus|VH1-3_IGHD2-15*01_IGHJ2*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREGYCSGGSCYSYWYFDLWGRGTLVTVSS

SEQ ID NO: 1845 - protein, 126 aa, Artificial Sequence
  Description of Artificial Sequence: Synthetic polypeptide
  gnl|Fabrus|VH1-3_IGHD2-2*01_IGHJ5*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREGYCSSTSCYADNWFDSWGQGTLVTVSS

SEQ ID NO: 1846 - protein, 130 aa, Artificial Sequence
  Description of Artificial Sequence: Synthetic polypeptide
  gnl|Fabrus|VH1-3_IGHD3-9*01_IGHJ6*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREYYDILTGYYNDYYYYYGMDVWGQGTTVTVSS

SEQ ID NO: 1847 - protein, 121 aa, Artificial Sequence
  Description of Artificial Sequence: Synthetic polypeptide
  gnl|Fabrus|VH1-3_IGHD5-18*01_IGHJ4*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARGGYSYGYDYFDYWGQGTLVTVSS

SEQ ID NO: 1848 - protein, 122 aa, Artificial Sequence
  Description of Artificial Sequence: Synthetic polypeptide
  gnl|Fabrus|VH1-3_IGHD6-6*01_IGHJ1*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCAREEYSSSSAEYFQHWGQGTLVTVSS

SEQ ID NO: 1849 - protein, 118 aa, Artificial Sequence
  Description of Artificial Sequence: Synthetic polypeptide
  gnl|Fabrus|VH1-3_IGHD7-27*01_IGHJ4*01 Protein
QVQLVQSGAEVKKPGASVKVSCKASGYTFTSYAMHWVRQAPGQRLEWMGWSNAGNGNTKYSQEFQGRVTITRDTSASTAYMELSSLRSEDMAVYYCARANWGDYFDYWGQGTLVTVSS

SEQ ID NO: 1850 - protein, 121 aa, Artificial Sequence
  Description of Artificial Sequence: Synthetic polypeptide
  gnl|Fabrus|VH1-45_IGHD1-26*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARWYSGSYYDYFDYWGQGTLVTVSS

SEQ ID NO: 1851 - protein, 130 aa, Artificial Sequence
  Description of Artificial Sequence: Synthetic polypeptide
  gnl|Fabrus|VH1-45_IGHD2-15*01_IGHJ6*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYCSGGSCYSDYYYYYGMDVWGQGTTVTVSS

SEQ ID NO: 1852 - protein, 125 aa, Artificial Sequence
  Description of Artificial Sequence: Synthetic polypeptide
  gnl|Fabrus|VH1-45_IGHD2-8*01_IGHJ3*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYCTNGVCYTDAFDVWGQGTMVTVSS

SEQ ID NO: 1853 - protein, 125 aa, Artificial Sequence
  Description of Artificial Sequence: Synthetic polypeptide
  gnl|Fabrus|VH1-45_IGHD3-10*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYYYYGSGSYYNDYFDYWGQGTLVTVSS

SEQ ID NO: 1854 - protein, 125 aa, Artificial Sequence
  Description of Artificial Sequence: Synthetic polypeptide
  gnl|Fabrus|VH1-45_IGHD3-16*01_IGHJ2*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYYYDYVWGSYAYTYWYFDLWGRGTLVT

SEQ ID NO: 1855 - protein, 121 aa, Artificial Sequence
  Description of Artificial Sequence: Synthetic polypeptide
  gnl|Fabrus|VH1-45_IGHD4-23*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYDYGGNSDYFDYWGQGTLVTVSS

SEQ ID NO: 1856 - protein, 121 aa, Artificial Sequence
  Description of Artificial Sequence: Synthetic polypeptide
  gnl|Fabrus|VH1-45_IGHD5-24*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARCRDGYNYDYFDYWGQGTLVTVSS

SEQ ID NO: 1857 - protein, 122 aa, Artificial Sequence
  Description of Artificial Sequence: Synthetic polypeptide
  gnl|Fabrus|VH1-45_IGHD6-19*01_IGHJ4*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARYGYSSGWYDYFDYWGQGTLVTVSS

SEQ ID NO: 1858 - protein, 123 aa, Artificial Sequence
  Description of Artificial Sequence: Synthetic polypeptide
  gnl|Fabrus|VH1-45_IGHD7-27*01_IGHJ6*01 Protein
QMQLVQSGAEVKKTGSSVKVSCKASGYTFTYRYLHWVRQAPGQALEWMGWITPFNGNTNYAQKFQDRVTITRDRSMSTAYMELSSLRSEDTAMYYCARSNWGDYYYYYGMDVWGQGTTVTVSS

SEQ ID NO: 1859 - protein, 121 aa, Artificial Sequence
  Description of Artificial Sequence: Synthetic polypeptide
  gnl|Fabrus|VH1-46_IGHD1-26*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGYSGSYYDYFDYWGQGTLVTVSS

SEQ ID NO: 1860 - protein, 120 aa, Artificial Sequence
  Description of Artificial Sequence: Synthetic polypeptide
  gnl|Fabrus|VH1-46_IGHD4-17*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDDYGDYDYFDYWGQGTLVTVSS

SEQ ID NO: 1861 - protein, 121 aa, Artificial Sequence
  Description of Artificial Sequence: Synthetic polypeptide
  gnl|Fabrus|VH1-46_IGHD5-18*01_IGHJ4*01 Protein
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGGYSYGYDYFDYWGQGTLVTVSS

SEQ ID NO: 1862 - protein, 121 aa, Artificial Sequence
  Description of Artificial Sequence: Synthetic polypeptide
  gnl|Fabrus|VH1-58_IGHD1-26*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAGYSGSYYDYFDYWGQGTLVTVSS

SEQ ID NO: 1863 - protein, 126 aa, Artificial Sequence
  Description of Artificial Sequence: Synthetic polypeptide
  gnl|Fabrus|VH1-58_IGHD2-15*01_IGHJ2*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEGYCSGGSCYSYWYFDLWGRGTLVTVSS

SEQ ID NO: 1864 - protein, 130 aa, Artificial Sequence
  Description of Artificial Sequence: Synthetic polypeptide
  gnl|Fabrus|VH1-58_IGHD3-10*01_IGHJ6*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEYYYGSGSYYNDYYYYYGMDVWGQGTTVTVSS

SEQ ID NO: 1865 - protein, 120 aa, Artificial Sequence
  Description of Artificial Sequence: Synthetic polypeptide
  gnl|Fabrus|VH1-58_IGHD4-17*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAADDYGDYDYFDYWGQGTLVTVSS

SEQ ID NO: 1866 - protein, 121 aa, Artificial Sequence
  Description of Artificial Sequence: Synthetic polypeptide
  gnl|Fabrus|VH1-58_IGHD4-17*01_IGHJ4*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAGGYSYGYDYFDYWGQGTLVTVSS

SEQ ID NO: 1867 - protein, 122 aa, Artificial Sequence
  Description of Artificial Sequence: Synthetic polypeptide
  gnl|Fabrus|VH1-58_IGHD6-6*01_IGHJ1*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAEEYSSSSAEYFQHWGQGTLVTVSS

SEQ ID NO: 1868 - protein, 119 aa, Artificial Sequence
  Description of Artificial Sequence: Synthetic polypeptide
  gnl|Fabrus|VH1-58_IGHD7-27*01_IGHJ5*01 Protein
QMQLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAANWGDNWFDSWGQGTLVTVSS

SEQ ID NO: 1869 - protein, 120 aa, Artificial Sequence
  Description of Artificial Sequence: Synthetic polypeptide
  gnl|Fabrus|VH1-69_IGHD1-14*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGYNRNHDYFDYWGQGTLVTVSS

SEQ ID NO: 1870 - protein, 125 aa, Artificial Sequence
  Description of Artificial Sequence: Synthetic polypeptide
  gnl|Fabrus|VH1-69_IGHD2-2*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYCSSTSCYADYFDYWGQGTLVTVSS

SEQ ID NO: 1871 - protein, 130 aa, Artificial Sequence
  Description of Artificial Sequence: Synthetic polypeptide
  gnl|Fabrus|VH1-69_IGHD2-8*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYCTNGVCYTDYYYYYGMDVWGQGTTVTVSS

SEQ ID NO: 1872 - protein, 127 aa, Artificial Sequence
  Description of Artificial Sequence: Synthetic polypeptide
  gnl|Fabrus|VH1-69_IGHD3-16*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDYVWGSYAYTDYFDYWGQGTLVTVSS

SEQ ID NO: 1873 - protein, 125 aa, Artificial Sequence
  Description of Artificial Sequence: Synthetic polypeptide
  gnl|Fabrus|VH1-69_IGHD3-3*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDFWSGYYTDYFDYWGQGTLVTVSS

SEQ ID NO: 1874 - protein, 130 aa, Artificial Sequence
  Description of Artificial Sequence: Synthetic polypeptide
  gnl|Fabrus|VH1-69_IGHD3-9*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREYYDILTGYYNDYYYYYGMDVWGQGTTVTVSS

SEQ ID NO: 1875 - protein, 120 aa, Artificial Sequence
  Description of Artificial Sequence: Synthetic polypeptide
  gnl|Fabrus|VH1-69_IGHD4-17*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARDDYGDYDYFDYWGQGTLVTVSS

SEQ ID NO: 1876 - protein, 122 aa, Artificial Sequence
  Description of Artificial Sequence: Synthetic polypeptide
  gnl|Fabrus|VH1-69_IGHD5-12*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGGYSGYDYDYFDYWGQGTLVTVSS

SEQ ID NO: 1877 - protein, 126 aa, Artificial Sequence
  Description of Artificial Sequence: Synthetic polypeptide
  gnl|Fabrus|VH1-69_IGHD5-24*01_IGHJ6*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRDGYNYDYYYYYGMDVWGQGTTVTVSS

SEQ ID NO: 1878 - protein, 122 aa, Artificial Sequence
  Description of Artificial Sequence: Synthetic polypeptide
  gnl|Fabrus|VH1-69_IGHD6-19*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGYSSGWYDYFDYWGQGTLVTVSS

SEQ ID NO: 1879 - protein, 122 aa, Artificial Sequence
  Description of Artificial Sequence: Synthetic polypeptide
  gnl|Fabrus|VH1-69_IGHD6-6*01_IGHJ1*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREEYSSSSAEYFQHWGQGTLVTVSS

SEQ ID NO: 1880 - protein, 118 aa, Artificial Sequence
  Description of Artificial Sequence: Synthetic polypeptide
  gnl|Fabrus|VH1-69_IGHD7-27*01_IGHJ4*01 Protein
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARELTGDYFDYWGQGTLVTVSS

SEQ ID NO: 1881 - protein, 121 aa, Artificial Sequence
  Description of Artificial Sequence: Synthetic polypeptide
  gnl|Fabrus|VH1-8_IGHD1-26*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYSGSYYDYFDYWGQGTLVTVSS

SEQ ID NO: 1882 - protein, 130 aa, Artificial Sequence
  Description of Artificial Sequence: Synthetic polypeptide
  gnl|Fabrus|VH1-8_IGHD2-15*01_IGHJ6*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYCSGGSCYSDYYYYYGMDVWGQGTTVTVSS

SEQ ID NO: 1883 - protein, 125 aa, Artificial Sequence
  Description of Artificial Sequence: Synthetic polypeptide
  gnl|Fabrus|VH1-8_IGHD3-10*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGYYYGSGSYYNDYFDYWGQGTLVTVSS

SEQ ID NO: 1884 - protein, 120 aa, Artificial Sequence
  Description of Artificial Sequence: Synthetic polypeptide
  gnl|Fabrus|VH1-8_IGHD4-17*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDYGDYDYFDYWGQGTLVTVSS

SEQ ID NO: 1885 - protein, 121 aa, Artificial Sequence
  Description of Artificial Sequence: Synthetic polypeptide
  gnl|Fabrus|VH1-8_IGHD5-5*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGYSYGYDYFDYWGQGTLVTVSS

SEQ ID NO: 1886 - protein, 118 aa, Artificial Sequence
  Description of Artificial Sequence: Synthetic polypeptide
  gnl|Fabrus|VH1-8_IGHD7-27*01_IGHJ4*01 Protein
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARANWGDYFDYWGQGTLVTVSS

SEQ ID NO: 1887 - protein, 122 aa, Artificial Sequence
  Description of Artificial Sequence: Synthetic polypeptide
  gnl|Fabrus|VH2-26_IGHD1-20*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYNWNDDYFDYWGQGTLVTVSS

SEQ ID NO: 1888 - protein, 128 aa, Artificial Sequence
  Description of Artificial Sequence: Synthetic polypeptide
  gnl|Fabrus|VH2-26_IGHD2-15*01_IGHJ2*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYCSGGSCYSYWYFDLWGRGTLVTVSS

SEQ ID NO: 1889 - protein, 127 aa, Artificial Sequence
  Description of Artificial Sequence: Synthetic polypeptide
  gnl|Fabrus|VH2-26_IGHD2-2*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYCSSTSCYADYFDYWGQGTLVTVSS

SEQ ID NO: 1890 - protein, 127 aa, Artificial Sequence
  Description of Artificial Sequence: Synthetic polypeptide
  gnl|Fabrus|VH2-26_IGHD3-10*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYYYGSGSYYNDYFDYWGQGTLVTVSS

SEQ ID NO: 1891 - protein, 132 aa, Artificial Sequence
  Description of Artificial Sequence: Synthetic polypeptide
  gnl|Fabrus|VH2-26_IGHD3-9*01_IGHJ6*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRYYDILTGYYNDYYYYYGMDVWGQGTTVTVSS

SEQ ID NO: 1892 - protein, 122 aa, Artificial Sequence
  Description of Artificial Sequence: Synthetic polypeptide
  gnl|Fabrus|VH2-26_IGHD3-9*01_IGHJ6*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRDYSNYDYFDYWGQGTLVTVSS

SEQ ID NO: 1893 - protein, 124 aa, Artificial Sequence
  Description of Artificial Sequence: Synthetic polypeptide
  gnl|Fabrus|VH2-26_IGHD5-12*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYSGYDYDYFDYWGQGTLVTVSS

SEQ ID NO: 1894 - protein, 123 aa, Artificial Sequence
  Description of Artificial Sequence: Synthetic polypeptide
  gnl|Fabrus|VH2-26_IGHD5-12*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIRGYSYGYDYFDYWGQGTLVTVSS

SEQ ID NO: 1895 - protein, 123 aa, Artificial Sequence
  Description of Artificial Sequence: Synthetic polypeptide
  gnl|Fabrus|VH2-26_IGHD6-13*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIGYSSSWYDYFDYWGQGTLVTVSS

SEQ ID NO: 1896 - protein, 119 aa, Artificial Sequence
  Description of Artificial Sequence: Synthetic polypeptide
  gnl|Fabrus|VH2-26_IGHD7-27*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARILTGDYFDYWGQGTLVTVSS

SEQ ID NO: 1897 - protein, 120 aa, Artificial Sequence
  Description of Artificial Sequence: Synthetic polypeptide
  gnl|Fabrus|VH2-26_IGHD7-27*01_IGHJ4*01 Protein
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARIPNWGDYFDYWGQGTLVTVSS

SEQ ID NO: 1898 - protein, 123 aa, Artificial Sequence
  Description of Artificial Sequence: Synthetic polypeptide
  gnl|Fabrus|VH2-5_IGHD1-1*01_IGHJ5*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYNWNDDNWFDSWGQGTLVTVSS

SEQ ID NO: 1899 - protein, 132 aa, Artificial Sequence
  Description of Artificial Sequence: Synthetic polypeptide
  gnl|Fabrus|VH2-5_IGHD2-15*01_IGHJ6*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRGYCSGGSCYSDYYYYYGMDVWGQGTTVTVSS

SEQ ID NO: 1900 - protein, 129 aa, Artificial Sequence
  Description of Artificial Sequence: Synthetic polypeptide
  gnl|Fabrus|VH2-5_IGHD3-16*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYYDYVWGSYAYTDYFDYWGQGTLVTVSS

SEQ ID NO: 1901 - protein, 132 aa, Artificial Sequence
  Description of Artificial Sequence: Synthetic polypeptide
  gnl|Fabrus|VH2-5_IGHD3-9*01_IGHJ6*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRYYDILTGYYNDYYYYYGMDVWGQGTTVTVSS

SEQ ID NO: 1902 - protein, 124 aa, Artificial Sequence
  Description of Artificial Sequence: Synthetic polypeptide
  gnl|Fabrus|VH2-5_IGHD5-12*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRRGYSGYDYDYFDYWGQGTLVTVSS

SEQ ID NO: 1903 - protein, 123 aa, Artificial Sequence
  Description of Artificial Sequence: Synthetic polypeptide
  gnl|Fabrus|VH2-5_IGHD6-13*01_IGHJ4*01 Protein
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRGYSSSWYDYFDYWGQGTLVTVSS

SEQ ID NO: 1904 - protein, 123 aa, Artificial Sequence
  Description of Artificial Sequence: Synthetic polypeptide
  gnl|Fabrus|VH2-70_IGHD1-1*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYNWNDYWYFDLWGRGTLVTVSS

SEQ ID NO: 1905 - protein, 128 aa, Artificial Sequence
  Description of Artificial Sequence: Synthetic polypeptide
  gnl|Fabrus|VH2-70_IGHD2-15*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRGYCSGGSCYSYWYFDLWGRGTLVTVSS

SEQ ID NO: 1906 - protein, 127 aa, Artificial Sequence
  Description of Artificial Sequence: Synthetic polypeptide
  gnl|Fabrus|VH2-70_IGHD3-22*01_IGHJ4*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYYYDSSGYYYDYFDYWGQGTLVTVSS

SEQ ID NO: 1907 - protein, 132 aa, Artificial Sequence
  Description of Artificial Sequence: Synthetic polypeptide
  gnl|Fabrus|VH2-70_IGHD3-9*01_IGHJ6*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRYYDILTGYYNDYYYYYGMDVWGQGTTVTVSS

SEQ ID NO: 1908 - protein, 124 aa, Artificial Sequence
  Description of Artificial Sequence: Synthetic polypeptide
  gnl|Fabrus|VH2-70_IGHD5-12*01_IGHJ4*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIRGYSGYDYDYFDYWGQGTLVTVSS

SEQ ID NO: 1909 - protein, 121 aa, Artificial Sequence
  Description of Artificial Sequence: Synthetic polypeptide
  gnl|Fabrus|VH2-70_IGHD7-27*01_IGHJ2*01 Protein
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIPNWGYWYFDLWGRGTLVTVSS

SEQ ID NO: 1910 - protein, 121 aa, Artificial Sequence
  Description of Artificial Sequence: Synthetic polypeptide
  gnl|Fabrus|VH3-11_IGHD1-26*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYSGSYYDYFDYWGQGTLVTVSS

SEQ ID NO: 1911 - protein, 130 aa, Artificial Sequence
  Description of Artificial Sequence: Synthetic polypeptide
  gnl|Fabrus|VH3-11_IGHD2-2*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREGYCSSTSCYADYYYYYGMDVWGQGTTVTVSS

SEQ ID NO: 1912 - protein, 127 aa, Artificial Sequence
  Description of Artificial Sequence: Synthetic polypeptide
  gnl|Fabrus|VH3-11_IGHD3-16*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREYYDYVWGSYAYTDYFDYWGQGTLVTVSS

SEQ ID NO: 1913 - protein, 130 aa, Artificial Sequence
  Description of Artificial Sequence: Synthetic polypeptide
  gnl|Fabrus|VH3-11_IGHD3-9*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREYYDILTGYYNDYYYYYGMDVWGQGTTVTVSS

SEQ ID NO: 1914 - protein, 122 aa, Artificial Sequence
  Description of Artificial Sequence: Synthetic polypeptide
  gnl|Fabrus|VH3-11_IGHD4-23*01_IGHJ5*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDDYGGNSDNWFDSWGQGTLVTVSS

SEQ ID NO: 1915 - protein, 121 aa, Artificial Sequence
  Description of Artificial Sequence: Synthetic polypeptide
  gnl|Fabrus|VH3-11_IGHD5-18*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGGYSYGYDYFDYWGQGTLVTVSS

SEQ ID NO: 1916 - protein, 127 aa, Artificial Sequence
  Description of Artificial Sequence: Synthetic polypeptide
  gnl|Fabrus|VH3-11_IGHD6-19*01_IGHJ6*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREGYSSGWYDYYYYYGMDVWGQGTTVTVSS

SEQ ID NO: 1917 - protein, 122 aa, Artificial Sequence
  Description of Artificial Sequence: Synthetic polypeptide
  gnl|Fabrus|VH3-11_IGHD6-6*01_IGHJ1*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAREEYSSSSAEYFQHWGQGTLVTVSS

SEQ ID NO: 1918 - protein, 118 aa, Artificial Sequence
  Description of Artificial Sequence: Synthetic polypeptide
  gnl|Fabrus|VH3-11_IGHD7-27*01_IGHJ4*01 Protein
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARELTGDYFDYWGQGTLVTVSS

SEQ ID NO: 1919 - protein, 120 aa, Artificial Sequence
  Description of Artificial Sequence: Synthetic polypeptide
  gnl|Fabrus|VH3-13_IGHD1-26*01_IGHJ4*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGYSGSYYDYFDYWGQGTLVTVSS

SEQ ID NO: 1920 - protein, 125 aa, Artificial Sequence
  Description of Artificial Sequence: Synthetic polypeptide
  gnl|Fabrus|VH3-13_IGHD2-8*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREGYCTNGVCYTDNWFDSWGQGTLVTVSS

SEQ ID NO: 1921 - protein, 125 aa, Artificial Sequence
  Description of Artificial Sequence: Synthetic polypeptide
  gnl|Fabrus|VH3-13_IGHD3-3*01_IGHJ1*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREYYDFWSGYYTAEYFQHWGQGTLVTVSS

SEQ ID NO: 1922 - protein, 129 aa, Artificial Sequence
  Description of Artificial Sequence: Synthetic polypeptide
  gnl|Fabrus|VH3-13_IGHD3-9*01_IGHJ6*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREYYDILTGYYNDYYYYYGMDVWGQGTTVTVSS

SEQ ID NO: 1923 - protein, 121 aa, Artificial Sequence
  Description of Artificial Sequence: Synthetic polypeptide
  gnl|Fabrus|VH3-13_IGHD4-23*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDDYGGNSDNWFDSWGQGTLVTVSS

SEQ ID NO: 1924 - protein, 120 aa, Artificial Sequence
  Description of Artificial Sequence: Synthetic polypeptide
  gnl|Fabrus|VH3-13_IGHD5-5*01_IGHJ4*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGGYSYGYDYFDYWGQGTLVTVSS

SEQ ID NO: 1925 - protein, 121 aa, Artificial Sequence
  Description of Artificial Sequence: Synthetic polypeptide
  gnl|Fabrus|VH3-13_IGHD6-6*01_IGHJ1*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCAREEYSSSSAEYFQHWGQGTLVTVSS

SEQ ID NO: 1926 - protein, 118 aa, Artificial Sequence
  Description of Artificial Sequence: Synthetic polypeptide
  gnl|Fabrus|VH3-13_IGHD7-27*01_IGHJ5*01 Protein
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARANWGDNWFDSWGQGTLVTVSS

SEQ ID NO: 1927 - protein, 123 aa, Artificial Sequence
  Description of Artificial Sequence: Synthetic polypeptide
  gnl|Fabrus|VH3-15_IGHD1-26*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGYSGSYYDYFDYWGQGTLVTVSS

SEQ ID NO: 1928 - protein, 128 aa, Artificial Sequence
  Description of Artificial Sequence: Synthetic polypeptide
  gnl|Fabrus|VH3-15_IGHD2-15*01_IGHJ2*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEGYCSGGSCYSYWYFDLWGRGTLVTVSS

SEQ ID NO: 1929 - protein, 132 aa, Artificial Sequence
  Description of Artificial Sequence: Synthetic polypeptide
  gnl|Fabrus|VH3-15_IGHD2-15*01_IGHJ6*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEGYCSGGSCYSDYYYYYGMDVWGQGTTVTVSS

SEQ ID NO: 1930 - protein, 127 aa, Artificial Sequence
  Description of Artificial Sequence: Synthetic polypeptide
  gnl|Fabrus|VH3-15_IGHD3-10*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEYYYGSGSYYNDYFDYWGQGTLVTVSS

SEQ ID NO: 1931 - protein, 128 aa, Artificial Sequence
  Description of Artificial Sequence: Synthetic polypeptide
  gnl|Fabrus|VH3-15_IGHD3-9*01_IGHJ2*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEYYDILTGYYNYWYFDLWGRGTLVTVSS

SEQ ID NO: 1932 - protein, 124 aa, Artificial Sequence
  Description of Artificial Sequence: Synthetic polypeptide
  gnl|Fabrus|VH3-15_IGHD5-12*01_IGHJ4*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGGYSGYDYDYFDYWGQGTLVTVSS

SEQ ID NO: 1933 - protein, 124 aa, Artificial Sequence
  Description of Artificial Sequence: Synthetic polypeptide
  gnl|Fabrus|VH3-15_IGHD6-6*01_IGHJ1*01 Protein
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEEYSSSSAEYFQHWGQGTLVTVSS

SEQ ID NO: 1934 - protein, 121 aa, Artificial Sequence
  Description of Artificial Sequence: Synthetic polypeptide
  gnl|Fabrus|VH3-16_IGHD1-1*01_IGHJ1*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRRYNWNDAEYFQHWGQGTLVTVSS

SEQ ID NO: 1935 - protein, 125 aa, Artificial Sequence
  Description of Artificial Sequence: Synthetic polypeptide
  gnl|Fabrus|VH3-16_IGHD1-7*01_IGHJ6*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRRYNWNYDYYYYYGMDVWGQGTTVTVSS

SEQ ID NO: 1936 - protein, 126 aa, Artificial Sequence
  Description of Artificial Sequence: Synthetic polypeptide
  gnl|Fabrus|VH3-16_IGHD2-15*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYCSGGSCYSYWYFDLWGRGTLVTVSS

SEQ ID NO: 1937 - protein, 126 aa, Artificial Sequence
  Description of Artificial Sequence: Synthetic polypeptide
  gnl|Fabrus|VH3-16_IGHD2-2*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYCSSTSCYAYWYFDLWGRGTLVTVSS

SEQ ID NO: 1938 - protein, 125 aa, Artificial Sequence
  Description of Artificial Sequence: Synthetic polypeptide
  gnl|Fabrus|VH3-16_IGHD3-10*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKYYYGSGSYYNDYFDYWGQGTLVTVSS

SEQ ID NO: 1939 - protein, 121 aa, Artificial Sequence
  Description of Artificial Sequence: Synthetic polypeptide
  gnl|Fabrus|VH3-16_IGHD4-4*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRNDYSNYYWYFDLWGRGTLVTVSS

SEQ ID NO: 1940 - protein, 121 aa, Artificial Sequence
  Description of Artificial Sequence: Synthetic polypeptide
  gnl|Fabrus|VH3-16_IGHD5-24*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRSRDGYNYDYFDYWGQGTLVTVSS

SEQ ID NO: 1941 - protein, 122 aa, Artificial Sequence
  Description of Artificial Sequence: Synthetic polypeptide
  gnl|Fabrus|VH3-16_IGHD6-13*01_IGHJ4*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRKGYSSSWYDYFDYWGQGTLVTVSS

SEQ ID NO: 1942 - protein, 119 aa, Artificial Sequence
  Description of Artificial Sequence: Synthetic polypeptide
  gnl|Fabrus|VH3-16_IGHD7-27*01_IGHJ2*01 Protein
EVQLVESGGGLVQPGGSLRLSCAASGFTFSNSDMNWARKAPGKGLEWVSGVSWNGSRTHYVDSVKRRFIISRDNSRNSLYLQKNRRRAEDMAVYYCVRTNWGYWYFDLWGRGTLVTVSS

SEQ ID NO: 1943 - protein, 120 aa, Artificial Sequence
  Description of Artificial Sequence: Synthetic polypeptide
  gnl|Fabrus|VH3-20_IGHD1-14*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGYNRNHDYFDYWGQGTLVTVSS

SEQ ID NO: 1944 - protein, 126 aa, Artificial Sequence
  Description of Artificial Sequence: Synthetic polypeptide
  gnl|Fabrus|VH3-20_IGHD2-15*01_IGHJ2*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREGYCSGGSCYSYWYFDLWGRGTLVTVSS

SEQ ID NO: 1945 - protein, 124 aa, Artificial Sequence
  Description of Artificial Sequence: Synthetic polypeptide
  gnl|Fabrus|VH3-20_IGHD2-8*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREDIVLMVYAIHYFDYWGQGTLVTVSS

SEQ ID NO: 1946 - protein, 125 aa, Artificial Sequence
  Description of Artificial Sequence: Synthetic polypeptide
  gnl|Fabrus|VH3-20_IGHD3-10*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREYYYGSGSYYNDYFDYWGQGTLVTVSS

SEQ ID NO: 1947 - protein, 130 aa, Artificial Sequence
  Description of Artificial Sequence: Synthetic polypeptide
  gnl|Fabrus|VH3-20_IGHD3-9*01_IGHJ6*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREYYDILTGYYNDYYYYYGMDVWGQGTTVTVSS

SEQ ID NO: 1948 - protein, 121 aa, Artificial Sequence
  Description of Artificial Sequence: Synthetic polypeptide
  gnl|Fabrus|VH3-20_IGHD4-23*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARDDYGGNSDYFDYWGQGTLVTVSS

SEQ ID NO: 1949 - protein, 122 aa, Artificial Sequence
  Description of Artificial Sequence: Synthetic polypeptide
  gnl|Fabrus|VH3-20_IGHD5-12*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGGYSGYDYDYFDYWGQGTLVTVSS

SEQ ID NO: 1950 - protein, 122 aa, Artificial Sequence
  Description of Artificial Sequence: Synthetic polypeptide
  gnl|Fabrus|VH3-20_IGHD6-13*01_IGHJ4*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREGYSSSWYDYFDYWGQGTLVTVSS

SEQ ID NO: 1951 - protein, 119 aa, Artificial Sequence
  Description of Artificial Sequence: Synthetic polypeptide
  gnl|Fabrus|VH3-20_IGHD7-27*01_IGHJ2*01 Protein
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARANWGYWYFDLWGRGTLVTVSS

SEQ ID NO: 1952 - protein, 121 aa, Artificial Sequence
  Description of Artificial Sequence: Synthetic polypeptide
  gnl|Fabrus|VH3-21_IGHD1-26*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGYSGSYYDYFDYWGQGTLVTVSS

SEQ ID NO: 1953 - protein, 126 aa, Artificial Sequence
  Description of Artificial Sequence: Synthetic polypeptide
  gnl|Fabrus|VH3-21_IGHD2-2*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYCSSTSCYADNWFDSWGQGTLVTVSS

SEQ ID NO: 1954 - protein, 125 aa, Artificial Sequence
  Description of Artificial Sequence: Synthetic polypeptide
  gnl|Fabrus|VH3-21_IGHD3-22*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREYYYDSSGYYYDYFDYWGQGTLVTVSS

SEQ ID NO: 1955 - protein, 122 aa, Artificial Sequence
  Description of Artificial Sequence: Synthetic polypeptide
  gnl|Fabrus|VH3-21_IGHD4-23*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDDYGGNSDNWFDSWGQGTLVTVSS

SEQ ID NO: 1956 - protein, 122 aa, Artificial Sequence
  Description of Artificial Sequence: Synthetic polypeptide
  gnl|Fabrus|VH3-21_IGHD5-24*01_IGHJ5*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGRDGYNYDNWFDSWGQGTLVTVSS

SEQ ID NO: 1957 - protein, 123 aa, Artificial Sequence
  Description of Artificial Sequence: Synthetic polypeptide
  gnl|Fabrus|VH3-21_IGHD6-19*01_IGHJ1*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYSSGWYAEYFQHWGQGTLVTVSS

SEQ ID NO: 1958 - protein, 118 aa, Artificial Sequence
  Description of Artificial Sequence: Synthetic polypeptide
  gnl|Fabrus|VH3-21_IGHD7-27*01_IGHJ4*01 Protein
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARANWGDYFDYWGQGTLVTVSS

SEQ ID NO: 1959 - protein, 121 aa, Artificial Sequence
  Description of Artificial Sequence: Synthetic polypeptide
  gnl|Fabrus|VH3-23_IGHD1-1*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYNWNDAEYFQHWGQGTLVTVSS

SEQ ID NO: 1960 - protein, 120 aa, Artificial Sequence
  Description of Artificial Sequence: Synthetic polypeptide
  gnl|Fabrus|VH3-23_IGHD1-1*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGTTGTNYFDYWGQGTLVTVSS

SEQ ID NO: 1961 - protein, 120 aa, Artificial Sequence
  Description of Artificial Sequence: Synthetic polypeptide
  gnl|Fabrus|VH3-23_IGHD1-20*01_IGHJ3*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYNWNDDAFDVWGQGTMVTVSS

SEQ ID NO: 1962 - protein, 121 aa, Artificial Sequence
  Description of Artificial Sequence: Synthetic polypeptide
  gnl|Fabrus|VH3-23_IGHD1-26*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSGSYYDYFDYWGQGTLVTVSS

SEQ ID NO: 1963 - protein, 125 aa, Artificial Sequence
  Description of Artificial Sequence: Synthetic polypeptide
  gnl|Fabrus|VH3-23_IGHD2-15*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYCSGGSCYSDYFDYWGQGTLVTVSS

SEQ ID NO: 1964 - protein, 125 aa, Artificial Sequence
  Description of Artificial Sequence: Synthetic polypeptide
  gnl|Fabrus|VH3-23_IGHD2-21*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEAYCGGDCYSAEYFQHWGQGTLVTVSS

SEQ ID NO: 1965 - protein, 125 aa, Artificial Sequence
  Description of Artificial Sequence: Synthetic polypeptide
  gnl|Fabrus|VH3-23_IGHD3-10*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYYGSGSYYNDYFDYWGQGTLVTVSS

SEQ ID NO: 1966 - protein, 127 aa, Artificial Sequence
  Description of Artificial Sequence: Synthetic polypeptide
  gnl|Fabrus|VH3-23_IGHD3-16*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYDYVWGSYAYTDYFDYWGQGTLVTVSS

SEQ ID NO: 1967 - protein, 125 aa, Artificial Sequence
  Description of Artificial Sequence: Synthetic polypeptide
  gnl|Fabrus|VH3-23_IGHD3-22*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYYDSSGYYYDYFDYWGQGTLVTVSS

SEQ ID NO: 1968 - protein, 126 aa, Artificial Sequence
  Description of Artificial Sequence: Synthetic polypeptide
  gnl|Fabrus|VH3-23_IGHD3-3*01_IGHJ5*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEYYDFWSGYYTDNWFDSWGQGTLVTVSS

SEQ ID NO: 1969 - protein, 120 aa, Artificial Sequence
  Description of Artificial Sequence: Synthetic polypeptide
  gnl|Fabrus|VH3-23_IGHD4-11*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDYSNYDYFDYWGQGTLVTVSS

SEQ ID NO: 1970 - protein, 122 aa, Artificial Sequence
  Description of Artificial Sequence: Synthetic polypeptide
  gnl|Fabrus|VH3-23_IGHD4-23*01_IGHJ2*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDDYGGNSYWYFDLWGRGTLVTVSS

SEQ ID NO: 1971 - protein, 122 aa, Artificial Sequence
  Description of Artificial Sequence: Synthetic polypeptide
  gnl|Fabrus|VH3-23_IGHD5-12*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGYSGYDYDYFDYWGQGTLVTVSS

SEQ ID NO: 1972 - protein, 122 aa, Artificial Sequence
  Description of Artificial Sequence: Synthetic polypeptide
  gnl|Fabrus|VH3-23_IGHD5-24*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGRDGYNYAEYFQHWGQGTLVTVSS

SEQ ID NO: 1973 - protein, 121 aa, Artificial Sequence
  Description of Artificial Sequence: Synthetic polypeptide
  gnl|Fabrus|VH3-23_IGHD5-24*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGYSYGYDYFDYWGQGTLVTVSS

SEQ ID NO: 1974 - protein, 122 aa, Artificial Sequence
  Description of Artificial Sequence: Synthetic polypeptide
  gnl|Fabrus|VH3-23_IGHD6-13*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYSSSWYDYFDYWGQGTLVTVSS

SEQ ID NO: 1975 - protein, 122 aa, Artificial Sequence
  Description of Artificial Sequence: Synthetic polypeptide
  gnl|Fabrus|VH3-23_IGHD6-25*01_IGHJ2*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGYSSGYYWYFDLWGRGTLVTVSS

SEQ ID NO: 1976 - protein, 122 aa, Artificial Sequence
  Description of Artificial Sequence: Synthetic polypeptide
  gnl|Fabrus|VH3-23_IGHD6-6*01_IGHJ1*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEEYSSSSAEYFQHWGQGTLVTVSS

SEQ ID NO: 1977 - protein, 118 aa, Artificial Sequence
  Description of Artificial Sequence: Synthetic polypeptide
  gnl|Fabrus|VH3-23_IGHD7-27*01_IGHJ4*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKANWGDYFDYWGQGTLVTVSS

SEQ ID NO: 1978 - protein, 123 aa, Artificial Sequence
  Description of Artificial Sequence: Synthetic polypeptide
  gnl|Fabrus|VH3-23_IGHD7-27*01_IGHJ6*01 Protein
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKANWGDYYYYYGMDVWGQGTTVTVSS

SEQ ID NO: 1979 - protein, 125 aa, Artificial Sequence
  Description of Artificial Sequence: Synthetic polypeptide
  gnl|Fabrus|VH3-30_IGHD1-1*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYNWNDDYYYYYGMDVWGQGTTVTVSS

SEQ ID NO: 1980 - protein, 122 aa, Artificial Sequence
  Description of Artificial Sequence: Synthetic polypeptide
  gnl|Fabrus|VH3-30_IGHD1-26*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYSGSYYAEYFQHWGQGTLVTVSS

SEQ ID NO: 1981 - protein, 121 aa, Artificial Sequence
  Description of Artificial Sequence: Synthetic polypeptide
  gnl|Fabrus|VH3-30_IGHD1-26*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGYSGSYYDYFDYWGQGTLVTVSS

SEQ ID NO: 1982 - protein, 126 aa, Artificial Sequence
  Description of Artificial Sequence: Synthetic polypeptide
  gnl|Fabrus|VH3-30_IGHD2-15*01_IGHJ2*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYCSGGSCYSYWYFDLWGRGTLVTVSS

SEQ ID NO: 1983 - protein, 130 aa, Artificial Sequence
  Description of Artificial Sequence: Synthetic polypeptide
  gnl|Fabrus|VH3-30_IGHD2-2*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYCSSTSCYADYYYYYGMDVWGQGTTVTVSS

SEQ ID NO: 1984 - protein, 126 aa, Artificial Sequence
  Description of Artificial Sequence: Synthetic polypeptide
  gnl|Fabrus|VH3-30_IGHD3-10*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGITMVRGVIITAEYFQHWGQGTLVTVSS

SEQ ID NO: 1985 - protein, 132 aa, Artificial Sequence
  Description of Artificial Sequence: Synthetic polypeptide
  gnl|Fabrus|VH3-30_IGHD3-16*01_IGHJ6*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREYYDYVWGSYAYTDYYYYYGMDVWGQGTTVTVSS

SEQ ID NO: 1986 - protein, 120 aa, Artificial Sequence
  Description of Artificial Sequence: Synthetic polypeptide
  gnl|Fabrus|VH3-30_IGHD4-17*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDDYGDYDYFDYWGQGTLVTVSS

SEQ ID NO: 1987 - protein, 122 aa, Artificial Sequence
  Description of Artificial Sequence: Synthetic polypeptide
  gnl|Fabrus|VH3-30_IGHD5-12*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARGGYSGYDYDYFDYWGQGTLVTVSS

SEQ ID NO: 1988 - protein, 122 aa, Artificial Sequence
  Description of Artificial Sequence: Synthetic polypeptide
  gnl|Fabrus|VH3-30_IGHD5-18*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREWIQLWLAEYFQHWGQGTLVTVSS

SEQ ID NO: 1989 - protein, 122 aa, Artificial Sequence
  Description of Artificial Sequence: Synthetic polypeptide
  gnl|Fabrus|VH3-30_IGHD6-13*01_IGHJ4*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREGYSSSWYDYFDYWGQGTLVTVSS

SEQ ID NO: 1990 - protein, 122 aa, Artificial Sequence
  Description of Artificial Sequence: Synthetic polypeptide
  gnl|Fabrus|VH3-30_IGHD6-6*01_IGHJ1*01 Protein
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREEYSSSSAEYFQHWGQGTLVTVSS

SEQ ID NO: 1991 - protein, 121 aa, Artificial Sequence
  Description of Artificial Sequence: Synthetic polypeptide
  gnl|Fabrus|VH3-30_IGHD6-6*01_IGHJ1*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRRYNWNDYWYFDLWGRGTLVTVSS

SEQ ID NO: 1992 - protein, 125 aa, Artificial Sequence
  Description of Artificial Sequence: Synthetic polypeptide
  gnl|Fabrus|VH3-35_IGHD1-20*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRRYNWNDDYYYYYGMDVWGQGTTVTVSS

SEQ ID NO: 1993 - protein, 126 aa, Artificial Sequence
  Description of Artificial Sequence: Synthetic polypeptide
  gnl|Fabrus|VH3-35_IGHD2-15*01_IGHJ2*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKGYCSGGSCYSYWYFDLWGRGTLVTVSS

SEQ ID NO: 1994 - protein, 129 aa, Artificial Sequence
  Description of Artificial Sequence: Synthetic polypeptide
  gnl|Fabrus|VH3-35_IGHD2-21*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKAYCGGDCYSDYYYYYGMDVWGQGTTVTVSS

SEQ ID NO: 1995 - protein, 125 aa, Artificial Sequence
  Description of Artificial Sequence: Synthetic polypeptide
  gnl|Fabrus|VH3-35_IGHD3-10*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKYYYGSGSYYNDYFDYWGQGTLVTVSS

SEQ ID NO: 1996 - protein, 130 aa, Artificial Sequence
  Description of Artificial Sequence: Synthetic polypeptide
  gnl|Fabrus|VH3-35_IGHD3-9*01_IGHJ6*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKYYDILTGYYNDYYYYYGMDVWGQGTTVTVSS

SEQ ID NO: 1997 - protein, 122 aa, Artificial Sequence
  Description of Artificial Sequence: Synthetic polypeptide
  gnl|Fabrus|VH3-35_IGHD5-12*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRSGYSGYDYDYFDYWGQGTLVTVSS

SEQ ID NO: 1998 - protein, 122 aa, Artificial Sequence
  Description of Artificial Sequence: Synthetic polypeptide
  gnl|Fabrus|VH3-35_IGHD6-13*01_IGHJ4*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRKGYSSSWYDYFDYWGQGTLVTVSS

SEQ ID NO: 1999 - protein, 119 aa, Artificial Sequence
  Description of Artificial Sequence: Synthetic polypeptide
  gnl|Fabrus|VH3-35_IGHD7-27*01_IGHJ1*01 Protein
EVQLVESGGGLVQPGGSLRLSCAASGFTFSNSDMNWVHQAPGKGLEWVSGVSWNGSRTHYADSVKGRFIISRDNSRNTLYLQTNSLRAEDTAVYYCVRTNWGAEYFQHWGQGTLVTVSS

SEQ ID NO: 2000 - protein, 119 aa, Artificial Sequence
  Description of Artificial Sequence: Synthetic polypeptide
  gnl|Fabrus|VH3-38_IGHD1-14*01_IGHJ5*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARWYNRNHDNWFDSWGQGTLVTVSS

SEQ ID NO: 2001 - protein, 123 aa, Artificial Sequence
  Description of Artificial Sequence: Synthetic polypeptide
  gnl|Fabrus|VH3-38_IGHD1-20*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARWYNWNDDYYYYYGMDVWGQGTTVTVSS

SEQ ID NO: 2002 - protein, 128 aa, Artificial Sequence
  Description of Artificial Sequence: Synthetic polypeptide
  gnl|Fabrus|VH3-38_IGHD2-15*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYGYCSGGSCYSDYYYYYGMDVWGQGTTVTVSS

SEQ ID NO: 2003 - protein, 124 aa, Artificial Sequence [sequence omitted]

SEQ ID NO: 2004 - protein, 123 aa, Artificial Sequence
  Description of Artificial Sequence: Synthetic polypeptide
  gnl|Fabrus|VH3-38_IGHD3-10*01_IGHJ4*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYYYYGSGSYYNDYFDYWGQGTLVTVSS

SEQ ID NO: 2005 - protein, 126 aa, Artificial Sequence
  Description of Artificial Sequence: Synthetic polypeptide
  gnl|Fabrus|VH3-38_IGHD3-16*01_IGHJ1*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYYYDYVWGSYAYTAEYFQHWGQGTLVTVSS

SEQ ID NO: 2006 - protein, 119 aa, Artificial Sequence
  Description of Artificial Sequence: Synthetic polypeptide
  gnl|Fabrus|VH3-38_IGHD4-17*01_IGHJ2*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYDYGDYYWYFDLWGRGTLVTVSS

SEQ ID NO: 2007 - protein, 119 aa, Artificial Sequence
  Description of Artificial Sequence: Synthetic polypeptide
  gnl|Fabrus|VH3-38_IGHD5-24*01_IGHJ3*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARCRDGYNYDAFDVWGQGTMVTVSS

SEQ ID NO: 2008 - protein, 120 aa, Artificial Sequence
  Description of Artificial Sequence: Synthetic polypeptide
  gnl|Fabrus|VH3-38_IGHD5-24*01_IGHJ3*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARYEYSSSSAEYFQHWGQGTLVTVSS

SEQ ID NO: 2009 - protein, 121 aa, Artificial Sequence
  Description of Artificial Sequence: Synthetic polypeptide
  gnl|Fabrus|VH3-38_IGHD7-27*01_IGHJ6*01 Protein
EVQLVESGGGLVQPRGSLRLSCAASGFTVSSNEMSWIRQAPGKGLEWVSSISGGSTYYADSRKGRFTISRDNSKNTLYLQMNNLRAEGTAVYYCARSNWGDYYYYYGMDVWGQGTTVTVSS

SEQ ID NO: 2010 - protein, 123 aa, Artificial Sequence
  Description of Artificial Sequence: Synthetic polypeptide
  gnl|Fabrus|VH3-43_IGHD1-26*01_IGHJ5*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYSGSYYDNWFDSWGQGTLVTVSS

SEQ ID NO: 2011 - protein, 126 aa, Artificial Sequence
  Description of Artificial Sequence: Synthetic polypeptide
  gnl|Fabrus|VH3-43_IGHD1-7*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYNWNYDYYYYYGMDVWGQGTTVTVSS

SEQ ID NO: 2012 - protein, 126 aa, Artificial Sequence
  Description of Artificial Sequence: Synthetic polypeptide
  gnl|Fabrus|VH3-43_IGHD2-2*01_IGHJ3*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRGYCSSTSCYADAFDVWGQGTMVTVSS

SEQ ID NO: 2013 - protein, 130 aa, Artificial Sequence
  Description of Artificial Sequence: Synthetic polypeptide
  gnl|Fabrus|VH3-43_IGHD2-21*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRAYCGGDCYSDYYYYYGMDVWGQGTTVTVSS

SEQ ID NO: 2014 - protein, 133 aa, Artificial Sequence
  Description of Artificial Sequence: Synthetic polypeptide
  gnl|Fabrus|VH3-43_IGHD3-16*01_IGHJ6*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYYDYVWGSYAYTDYYYYYGMDVWGQGTTVTVSS

SEQ ID NO: 2015 - protein, 126 aa, Artificial Sequence
  Description of Artificial Sequence: Synthetic polypeptide
  gnl|Fabrus|VH3-43_IGHD3-22*01_IGHJ4*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDRYYYDSSGYYYDYFDYWGQGTLVTVSS

SEQ ID NO: 2016 - protein, 122 aa, Artificial Sequence
  Description of Artificial Sequence: Synthetic polypeptide
  gnl|Fabrus|VH3-43_IGHD4-23*01_IGHJ3*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDSDYGGNSDAFDVWGQGTMVTVSS

SEQ ID NO: 2017 - protein, 123 aa, Artificial Sequence
  Description of Artificial Sequence: Synthetic polypeptide
  gnl|Fabrus|VH3-43_IGHD5-18*01_IGHJ5*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDSGYSYGYDNWFDSWGQGTLVTVSS

SEQ ID NO: 2018 - protein, 122 aa, Artificial Sequence
  Description of Artificial Sequence: Synthetic polypeptide
  gnl|Fabrus|VH3-43_IGHD6-13*01_IGHJ4*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDGYSSSWYDYFDYWGQGTLVTVSS

SEQ ID NO: 2019 - protein, 120 aa, Artificial Sequence
  Description of Artificial Sequence: Synthetic polypeptide
  gnl|Fabrus|VH3-43_IGHD7-27*01_IGHJ1*01 Protein
EVQLVESGGVVVQPGGSLRLSCAASGFTFDDYTMHWVRQAPGKGLEWVSLISWDGGSTYYADSVKGRFTISRDNSKNSLYLQMNSLRTEDTALYYCAKDTNWGAEYFQHWGQGTLVTVSS

SEQ ID NO: 2020 - protein, 122 aa, Artificial Sequence
  Description of Artificial Sequence: Synthetic polypeptide
  gnl|Fabrus|VH3-48_IGHD6-6*01_IGHJ1*01 Protein
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAREEYSSSSAEYFQHWGQGTLVTVSS

SEQ ID NO: 2021 - protein, 123 aa, Artificial Sequence
  Description of Artificial Sequence: Synthetic polypeptide
  gnl|Fabrus|VH3-49_IGHD1-26*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGYSGSYYDYFDYWGQGTLVTVSS

SEQ ID NO: 2022 - protein, 127 aa, Artificial Sequence
  Description of Artificial Sequence: Synthetic polypeptide
  gnl|Fabrus|VH3-49_IGHD1-7*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGYNWNYDYYYYYGMDVWGQGTTVTVSS

SEQ ID NO: 2023 - protein, 132 aa, Artificial Sequence
  Description of Artificial Sequence: Synthetic polypeptide
  gnl|Fabrus|VH3-49_IGHD2-2*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYCSSTSCYADYYYYYGMDVWGQGTTVTVSS

SEQ ID NO: 2024 - protein, 127 aa, Artificial Sequence
  Description of Artificial Sequence: Synthetic polypeptide
  gnl|Fabrus|VH3-49_IGHD2-8*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYCTNGVCYTDYFDYWGQGTLVTVSS

SEQ ID NO: 2025 - protein, 127 aa, Artificial Sequence
  Description of Artificial Sequence: Synthetic polypeptide
  gnl|Fabrus|VH3-49_IGHD3-22*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREYYYDSSGYYYDYFDYWGQGTLVTVSS

SEQ ID NO: 2026 - protein, 132 aa, Artificial Sequence
  Description of Artificial Sequence: Synthetic polypeptide
  gnl|Fabrus|VH3-49_IGHD3-9*01_IGHJ6*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREYYDILTGYYNDYYYYYGMDVWGQGTTVTVSS

SEQ ID NO: 2027 - protein, 123 aa, Artificial Sequence
  Description of Artificial Sequence: Synthetic polypeptide
  gnl|Fabrus|VH3-49_IGHD5-18*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGYSYGYDYFDYWGQGTLVTVSS

SEQ ID NO: 2028 - protein, 124 aa, Artificial Sequence
  Description of Artificial Sequence: Synthetic polypeptide
  gnl|Fabrus|VH3-49_IGHD6-13*01_IGHJ4*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTREGYSSSWYDYFDYWGQGTLVTVSS

SEQ ID NO: 2029 - protein, 121 aa, Artificial Sequence
  Description of Artificial Sequence: Synthetic polypeptide
  gnl|Fabrus|VH3-49_IGHD7-27*01_IGHJ1*01 Protein
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRANWGAEYFQHWGQGTLVTVSS

SEQ ID NO: 2030 - protein, 124 aa, Artificial Sequence
  Description of Artificial Sequence: Synthetic polypeptide
  gnl|Fabrus|VH3-53_IGHD1-14*01_IGHJ6*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGYNRNHDYYYYYGMDVWGQGTTVTVSS

SEQ ID NO: 2031 - protein, 120 aa, Artificial Sequence
  Description of Artificial Sequence: Synthetic polypeptide
  gnl|Fabrus|VH3-53_IGHD1-7*01_IGHJ1*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGYNWNYAEYFQHWGQGTLVTVSS

SEQ ID NO: 2032 - protein, 125 aa, Artificial Sequence
  Description of Artificial Sequence: Synthetic polypeptide
  gnl|Fabrus|VH3-53_IGHD2-2*01_IGHJ2*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGYCSSTSCYAYWYFDLWGRGTLVTVSS

SEQ ID NO: 2033 - protein, 124 aa, Artificial Sequence
  Description of Artificial Sequence: Synthetic polypeptide
  gnl|Fabrus|VH3-53_IGHD3-22*01_IGHJ3*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREYYYDSSGYYYDAFDVWGQGTMVTVSS

SEQ ID NO: 2034 - protein, 121 aa, Artificial Sequence
  Description of Artificial Sequence: Synthetic polypeptide
  gnl|Fabrus|VH3-53_IGHD4-23*01_IGHJ1*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDDYGGNSAEYFQHWGQGTLVTVSS

SEQ ID NO: 2035 - protein, 120 aa, Artificial Sequence
  Description of Artificial Sequence: Synthetic polypeptide
  gnl|Fabrus|VH3-53_IGHD5-5*01_IGHJ4*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGGYSYGYDYFDYWGQGTLVTVSS

SEQ ID NO: 2036 - protein, 121 aa, Artificial Sequence
  Description of Artificial Sequence: Synthetic polypeptide
  gnl|Fabrus|VH3-53_IGHD6-13*01_IGHJ3*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAREGYSSSWYDAFDVWGQGTMVTVSS

SEQ ID NO: 2037 - protein, 117 aa, Artificial Sequence
  Description of Artificial Sequence: Synthetic polypeptide
  gnl|Fabrus|VH3-53_IGHD7-27*01_IGHJ4*01 Protein
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARANWGDYFDYWGQGTLVTVSS

SEQ ID NO: 2038 - protein, 121 aa, Artificial Sequence
  Description of Artificial Sequence: Synthetic polypeptide
  gnl|Fabrus|VH3-64_IGHD1-26*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGYSGSYYDYFDYWGQGTLVTVSS

SEQ ID NO: 2039 - protein, 125 aa, Artificial Sequence
  Description of Artificial Sequence: Synthetic polypeptide
  gnl|Fabrus|VH3-64_IGHD1-7*01_IGHJ6*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGYNWNYDYYYYYGMDVWGQGTTVTVSS

SEQ ID NO: 2040 - protein, 126 aa, Artificial Sequence
  Description of Artificial Sequence: Synthetic polypeptide
  gnl|Fabrus|VH3-64_IGHD2-2*01_IGHJ5*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREGYCSSTSCYADNWFDSWGQGTLVTVSS

SEQ ID NO: 2041 - protein, 125 aa, Artificial Sequence
  Description of Artificial Sequence: Synthetic polypeptide
  gnl|Fabrus|VH3-64_IGHD3-3*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREYYDFWSGYYTDYFDYWGQGTLVTVSS

SEQ ID NO: 2042 - protein, 120 aa, Artificial Sequence
  Description of Artificial Sequence: Synthetic polypeptide
  gnl|Fabrus|VH3-64_IGHD4-17*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARDDYGDYDYFDYWGQGTLVTVSS

SEQ ID NO: 2043 - protein, 122 aa, Artificial Sequence
  Description of Artificial Sequence: Synthetic polypeptide
  gnl|Fabrus|VH3-64_IGHD5-12*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARGGYSGYDYDYFDYWGQGTLVTVSS

SEQ ID NO: 2044 - protein, 123 aa, Artificial Sequence
  Description of Artificial Sequence: Synthetic polypeptide
  gnl|Fabrus|VH3-64_IGHD6-19*01_IGHJ1*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCAREGYSSGWYAEYFQHWGQGTLVTVSS

SEQ ID NO: 2045 - protein, 118 aa, Artificial Sequence
  Description of Artificial Sequence: Synthetic polypeptide
  gnl|Fabrus|VH3-64_IGHD7-27*01_IGHJ4*01 Protein
EVQLVESGEGLVQPGGSLRLSCAASGFTFSSYAMHWVRQAPGKGLEYVSAISSNGGSTYYADSVKGRFTISRDNSKNTLYLQMGSLRAEDMAVYYCARANWGDYFDYWGQGTLVTVSS

SEQ ID NO: 2046 - protein, 121 aa, Artificial Sequence
  Description of Artificial Sequence: Synthetic polypeptide
  gnl|Fabrus|VH3-66_IGHD6-6*01_IGHJ1*01 Protein
EVQLVESGGGLIQPGGSLRLSCAASGFTVSSNYMSWVRQAPGKGLEWVSVIYSCGSTYYADSVKGRFTISRDNSKNTLYLQMNSLRAEDTAVYYCAREEYSSSSAEYFQHWGQGTLVTVSS

SEQ ID NO: 2047 - protein, 120 aa, Artificial Sequence
  Description of Artificial Sequence: Synthetic polypeptide
  gnl|Fabrus|VH3-7_IGHD1-20*01_IGHJ3*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYNWNDDAFDVWGQGTMVTVSS

SEQ ID NO: 2048 - protein, 125 aa, Artificial Sequence
  Description of Artificial Sequence: Synthetic polypeptide
  gnl|Fabrus|VH3-7_IGHD1-7*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGYNWNYDYYYYYGMDVWGQGTTVTVSS

SEQ ID NO: 2049 - protein, 125 aa, Artificial Sequence
  Description of Artificial Sequence: Synthetic polypeptide
  gnl|Fabrus|VH3-7_IGHD2-21*01_IGHJ5*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREAYCGGDCYSDNWFDSWGQGTLVTVSS

SEQ ID NO: 2050 - protein, 129 aa, Artificial Sequence
  Description of Artificial Sequence: Synthetic polypeptide
  gnl|Fabrus|VH3-7_IGHD2-8*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREDIVLMVYAIHYYYYYGMDVWGQGTTVTVSS

SEQ ID NO: 2051 - protein, 125 aa, Artificial Sequence
  Description of Artificial Sequence: Synthetic polypeptide
  gnl|Fabrus|VH3-7_IGHD3-22*01_IGHJ3*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREYYYDSSGYYYDAFDVWGQGTMVTVSS

SEQ ID NO: 2052 - protein, 130 aa, Artificial Sequence
  Description of Artificial Sequence: Synthetic polypeptide
  gnl|Fabrus|VH3-7_IGHD3-9*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREYYDILTGYYNDYYYYYGMDVWGQGTTVTVSS

SEQ ID NO: 2053 - protein, 120 aa, Artificial Sequence
  Description of Artificial Sequence: Synthetic polypeptide
  gnl|Fabrus|VH3-7_IGHD4-17*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDDYGDYDYFDYWGQGTLVTVSS

SEQ ID NO: 2054 - protein, 122 aa, Artificial Sequence
  Description of Artificial Sequence: Synthetic polypeptide
  gnl|Fabrus|VH3-7_IGHD5-12*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGGYSGYDYDYFDYWGQGTLVTVSS

SEQ ID NO: 2055 - protein, 121 aa, Artificial Sequence
  Description of Artificial Sequence: Synthetic polypeptide
  gnl|Fabrus|VH3-7_IGHD5-24*01_IGHJ4*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREVEMATINYFDYWGQGTLVTVSS

SEQ ID NO: 2056 - protein, 127 aa, Artificial Sequence
  Description of Artificial Sequence: Synthetic polypeptide
  gnl|Fabrus|VH3-7_IGHD6-19*01_IGHJ6*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGYSSGWYDYYYYYGMDVWGQGTTVTVSS

SEQ ID NO: 2057 - protein, 122 aa, Artificial Sequence
  Description of Artificial Sequence: Synthetic polypeptide
  gnl|Fabrus|VH3-7_IGHD6-6*01_IGHJ1*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREEYSSSSAEYFQHWGQGTLVTVSS

SEQ ID NO: 2058 - protein, 119 aa, Artificial Sequence
  Description of Artificial Sequence: Synthetic polypeptide
  gnl|Fabrus|VH3-7_IGHD7-27*01_IGHJ2*01 Protein
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARANWGYWYFDLWGRGTLVTVSS

SEQ ID NO: 2059 - protein, 122 aa, Artificial Sequence
  Description of Artificial Sequence: Synthetic polypeptide
  gnl|Fabrus|VH3-72_IGHD1-1*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGYNWNDDYFDYWGQGTLVTVSS

SEQ ID NO: 2060 - protein, 128 aa, Artificial Sequence
  Description of Artificial Sequence: Synthetic polypeptide
  gnl|Fabrus|VH3-72_IGHD2-15*01_IGHJ1*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREGYCSGGSCYSAEYFQHWGQGTLVTVSS

SEQ ID NO: 2061 - protein, 127 aa, Artificial Sequence
  Description of Artificial Sequence: Synthetic polypeptide
  gnl|Fabrus|VH3-72_IGHD3-22*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREYYYDSSGYYYDYFDYWGQGTLVTVSS

SEQ ID NO: 2062 - protein, 132 aa, Artificial Sequence
  Description of Artificial Sequence: Synthetic polypeptide
  gnl|Fabrus|VH3-72_IGHD3-9*01_IGHJ6*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREYYDILTGYYNDYYYYYGMDVWGQGTTVTVSS

SEQ ID NO: 2063 - protein, 124 aa, Artificial Sequence
  Description of Artificial Sequence: Synthetic polypeptide
  gnl|Fabrus|VH3-72_IGHD4-23*01_IGHJ2*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARDDYGGNSYWYFDLWGRGTLVTVSS

SEQ ID NO: 2064 - protein, 123 aa, Artificial Sequence
  Description of Artificial Sequence: Synthetic polypeptide
  gnl|Fabrus|VH3-72_IGHD5-18*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGGYSYGYDYFDYWGQGTLVTVSS

SEQ ID NO: 2065 - protein, 128 aa, Artificial Sequence
  Description of Artificial Sequence: Synthetic polypeptide
  gnl|Fabrus|VH3-72_IGHD5-18*01_IGHJ4*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARGRDGYNYDYYYYYGMDVWGQGTTVTVSS

SEQ ID NO: 2066 - protein, 124 aa, Artificial Sequence
  Description of Artificial Sequence: Synthetic polypeptide
  gnl|Fabrus|VH3-72_IGHD6-6*01_IGHJ1*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCAREEYSSSSAEYFQHWGQGTLVTVSS

SEQ ID NO: 2067 - protein, 121 aa, Artificial Sequence
  Description of Artificial Sequence: Synthetic polypeptide
  gnl|Fabrus|VH3-72_IGHD7-27*01_IGHJ2*01 Protein
EVQLVESGGGLVQPGGSLRLSCAASGFTFSDHYMDWVRQAPGKGLEWVGRTRNKANSYTTEYAASVKGRFTISRDDSKNSLYLQMNSLKTEDTAVYYCARANWGYWYFDLWGRGTLVTVSS

SEQ ID NO: 2068 - protein, 123 aa, Artificial Sequence
  Description of Artificial Sequence: Synthetic polypeptide
  gnl|Fabrus|VH3-73_IGHD1-1*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRRYNWNDDNWFDSWGQGTLVTVSS

SEQ ID NO: 2069 - protein, 128 aa, Artificial Sequence
  Description of Artificial Sequence: Synthetic polypeptide
  gnl|Fabrus|VH3-73_IGHD2-8*01_IGHJ2*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQGYCTNGVCYTYWYFDLWGRGTLVTVSS

SEQ ID NO: 2070 - protein, 127 aa, Artificial Sequence
  Description of Artificial Sequence: Synthetic polypeptide
  gnl|Fabrus|VH3-73_IGHD3-22*01_IGHJ4*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQYYYDSSGYYYDYFDYWGQGTLVTVSS

SEQ ID NO: 2071 - protein, 132 aa, Artificial Sequence
  Description of Artificial Sequence: Synthetic polypeptide
  gnl|Fabrus|VH3-73_IGHD3-9*01_IGHJ6*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQYYDILTGYYNDYYYYYGMDVWGQGTTVTVSS

SEQ ID NO: 2072 - protein, 127 aa, Artificial Sequence
  Description of Artificial Sequence: Synthetic polypeptide
  gnl|Fabrus|VH3-73_IGHD4-11*01_IGHJ6*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRHDYSNYDYYYYYGMDVWGQGTTVTVSS

SEQ ID NO: 2073 - protein, 124 aa, Artificial Sequence
  Description of Artificial Sequence: Synthetic polypeptide
  gnl|Fabrus|VH3-73_IGHD4-23*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRHDYGGNSDNWFDSWGQGTLVTVSS

SEQ ID NO: 2074 - protein, 124 aa, Artificial Sequence
  Description of Artificial Sequence: Synthetic polypeptide
  gnl|Fabrus|VH3-73_IGHD5-12*01_IGHJ4*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRRGYSGYDYDYFDYWGQGTLVTVSS

SEQ ID NO: 2075 - protein, 125 aa, Artificial Sequence
  Description of Artificial Sequence: Synthetic polypeptide
  gnl|Fabrus|VH3-73_IGHD6-19*01_IGHJ1*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRQGYSSGWYAEYFQHWGQGTLVTVSS

SEQ ID NO: 2076 - protein, 121 aa, Artificial Sequence
  Description of Artificial Sequence: Synthetic polypeptide
  gnl|Fabrus|VH3-73_IGHD7-27*01_IGHJ5*01 Protein
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRPNWGDNWFDSWGQGTLVTVSS

SEQ ID NO: 2077 - protein, 125 aa, Artificial Sequence
  Description of Artificial Sequence: Synthetic polypeptide
  gnl|Fabrus|VH3-74_IGHD1-1*01_IGHJ6*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGYNWNDDYYYYYGMDVWGQGTTVTVSS

SEQ ID NO: 2078 - protein, 121 aa, Artificial Sequence
  Description of Artificial Sequence: Synthetic polypeptide
  gnl|Fabrus|VH3-74_IGHD1-26*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGYSGSYYDYFDYWGQGTLVTVSS

SEQ ID NO: 2079 - protein, 126 aa, Artificial Sequence
  Description of Artificial Sequence: Synthetic polypeptide
  gnl|Fabrus|VH3-74_IGHD2-2*01_IGHJ5*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREGYCSSTSCYADNWFDSWGQGTLVTVSS

SEQ ID NO: 2080 - protein, 126 aa, Artificial Sequence
  Description of Artificial Sequence: Synthetic polypeptide
  gnl|Fabrus|VH3-74_IGHD3-22*01_IGHJ5*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREYYYDSSGYYYDNWFDSWGQGTLVTVSS

SEQ ID NO: 2081 - protein, 121 aa, Artificial Sequence
  Description of Artificial Sequence: Synthetic polypeptide
  gnl|Fabrus|VH3-74_IGHD4-17*01_IGHJ1*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARDDYGDYAEYFQHWGQGTLVTVSS

SEQ ID NO: 2082 - protein, 122 aa, Artificial Sequence
  Description of Artificial Sequence: Synthetic polypeptide
  gnl|Fabrus|VH3-74_IGHD5-12*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGGYSGYDYDYFDYWGQGTLVTVSS

SEQ ID NO: 2083 - protein, 122 aa, Artificial Sequence
  Description of Artificial Sequence: Synthetic polypeptide
  gnl|Fabrus|VH3-74_IGHD6-6*01_IGHJ1*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREEYSSSSAEYFQHWGQGTLVTVSS

SEQ ID NO: 2084 - protein, 118 aa, Artificial Sequence
  Description of Artificial Sequence: Synthetic polypeptide
  gnl|Fabrus|VH3-74_IGHD7-27*01_IGHJ4*01 Protein
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARANWGDYFDYWGQGTLVTVSS

SEQ ID NO: 2085 - protein, 126 aa, Artificial Sequence
  Description of Artificial Sequence: Synthetic polypeptide
  gnl|Fabrus|VH3-9_IGHD1-1*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYNWNDDYYYYYGMDVWGQGTTVTVSS

SEQ ID NO: 2086 - protein, 122 aa, Artificial Sequence
  Description of Artificial Sequence: Synthetic polypeptide
  gnl|Fabrus|VH3-9_IGHD1-7*01_IGHJ5*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYNWNYDNWFDSWGQGTLVTVSS

SEQ ID NO: 2087 - protein, 126 aa, Artificial Sequence
  Description of Artificial Sequence: Synthetic polypeptide
  gnl|Fabrus|VH3-9_IGHD2-2*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRGYCSSTSCYADYFDYWGQGTLVTVSS

SEQ ID NO: 2088 - protein, 133 aa, Artificial Sequence
  Description of Artificial Sequence: Synthetic polypeptide
  gnl|Fabrus|VH3-9_IGHD3-16*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYYDYVWGSYAYTDYYYYYGMDVWGQGTTVTVSS

SEQ ID NO: 2089 - protein, 126 aa, Artificial Sequence
  Description of Artificial Sequence: Synthetic polypeptide
  gnl|Fabrus|VH3-9_IGHD3-22*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDRYYYDSSGYYYDYFDYWGQGTLVTVSS

SEQ ID NO: 2090 - protein, 121 aa, Artificial Sequence
  Description of Artificial Sequence: Synthetic polypeptide
  gnl|Fabrus|VH3-9_IGHD4-11*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSDYSNYDYFDYWGQGTLVTVSS

SEQ ID NO: 2091 - protein, 123 aa, Artificial Sequence
  Description of Artificial Sequence: Synthetic polypeptide
  gnl|Fabrus|VH3-9_IGHD5-24*01_IGHJ1*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDSRDGYNYAEYFQHWGQGTLVTVSS

SEQ ID NO: 2092 - protein, 122 aa, Artificial Sequence
  Description of Artificial Sequence: Synthetic polypeptide
  gnl|Fabrus|VH3-9_IGHD6-13*01_IGHJ4*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSSSWYDYFDYWGQGTLVTVSS

SEQ ID NO: 2093 - protein, 126 aa, Artificial Sequence
  Description of Artificial Sequence: Synthetic polypeptide
  gnl|Fabrus|VH3-9_IGHD6-25*01_IGHJ6*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSSGYDYYYYYGMDVWGQGTTVTVSS

SEQ ID NO: 2094 - protein, 120 aa, Artificial Sequence
  Description of Artificial Sequence: Synthetic polypeptide
  gnl|Fabrus|VH3-9_IGHD7-27*01_IGHJ2*01 Protein
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDTNWGYWYFDLWGRGTLVTVSS

SEQ ID NO: 2095 - protein, 121 aa, Artificial Sequence
  Description of Artificial Sequence: Synthetic polypeptide
  gnl|Fabrus|VH4-28_IGHD1-20*01_IGHJ1*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRYNWNDAEYFQHWGQGTLVTVSS

SEQ ID NO: 2096 - protein, 125 aa, Artificial Sequence
  Description of Artificial Sequence: Synthetic polypeptide
  gnl|Fabrus|VH4-28_IGHD1-7*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRYNWNYDYYYYYGMDVWGQGTTVTVSS

SEQ ID NO: 2097 - protein, 130 aa, Artificial Sequence
  Description of Artificial Sequence: Synthetic polypeptide
  gnl|Fabrus|VH4-28_IGHD2-15*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYCSGGSCYSDYYYYYGMDVWGQGTTVTVSS

SEQ ID NO: 2098 - protein, 128 aa, Artificial Sequence
  Description of Artificial Sequence: Synthetic polypeptide
  gnl|Fabrus|VH4-28_IGHD3-16*01_IGHJ2*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKYYDYVWGSYAYTYWYFDLWGRGTLVTVSS

SEQ ID NO: 2099 - protein, 130 aa, Artificial Sequence
  Description of Artificial Sequence: Synthetic polypeptide
  gnl|Fabrus|VH4-28_IGHD3-9*01_IGHJ6*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKYYDILTGYYNDYYYYYGMDVWGQGTTVTVSS

SEQ ID NO: 2100 - protein, 120 aa, Artificial Sequence
  Description of Artificial Sequence: Synthetic polypeptide
  gnl|Fabrus|VH4-28_IGHD4-4*01_IGHJ4*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARNDYSNYDYFDYWGQGTLVTVSS

SEQ ID NO: 2101 - protein, 122 aa, Artificial Sequence
  Description of Artificial Sequence: Synthetic polypeptide
  gnl|Fabrus|VH4-28_IGHD5-5*01_IGHJ1*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARSGYSYGYAEYFQHWGQGTLVTVSS

SEQ ID NO: 2102 - protein, 122 aa, Artificial Sequence
  Description of Artificial Sequence: Synthetic polypeptide
  gnl|Fabrus|VH4-28_IGHD6-13*01_IGHJ4*01 Protein
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARKGYSSSWYDYFDYWGQGTLVTVSS

SEQ ID NO: 2103 - protein, 131 aa, Artificial Sequence
  Description of Artificial Sequence: Synthetic polypeptide
  gnl|Fabrus|VH4-31_IGHD2-2*01_IGHJ6*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYCSSTSCYADYYYYYGMDVWGQGTTVTVSS

SEQ ID NO: 2104 - protein, 126 aa, Artificial Sequence
  Description of Artificial Sequence: Synthetic polypeptide
  gnl|Fabrus|VH4-31_IGHD3-10*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYYGSGSYYNDYFDYWGQGTLVTVSS

SEQ ID NO: 2105 - protein, 131 aa, Artificial Sequence
  Description of Artificial Sequence: Synthetic polypeptide
  gnl|Fabrus|VH4-31_IGHD3-9*01_IGHJ6*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREYYDILTGYYNDYYYYYGMDVWGQGTTVTVSS

SEQ ID NO: 2106 - protein, 122 aa, Artificial Sequence
  Description of Artificial Sequence: Synthetic polypeptide
  gnl|Fabrus|VH4-31_IGHD4-17*01_IGHJ5*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDDYGDYDNWFDSWGQGTLVTVSS

SEQ ID NO: 2107 - protein, 123 aa, Artificial Sequence
  Description of Artificial Sequence: Synthetic polypeptide
  gnl|Fabrus|VH4-31_IGHD5-12*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGGYSGYDYDYFDYWGQGTLVTVSS

SEQ ID NO: 2108 - protein, 123 aa, Artificial Sequence
  Description of Artificial Sequence: Synthetic polypeptide
  gnl|Fabrus|VH4-31_IGHD6-13*01_IGHJ4*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGYSSSWYDYFDYWGQGTLVTVSS

SEQ ID NO: 2109 - protein, 123 aa, Artificial Sequence
  Description of Artificial Sequence: Synthetic polypeptide
  gnl|Fabrus|VH4-31_IGHD6-6*01_IGHJ1*01 Protein
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREEYSSSSAEYFQHWGQGTLVTVSS

SEQ ID NO: 2110 - protein, 119 aa, Artificial Sequence
  Description of Artificial Sequence: Synthetic polypeptide
  gnl|Fabrus|VH4-34_IGHD1-7*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYNWNYDYFDYWGQGTLVTVSS

SEQ ID NO: 2111 - protein, 124 aa, Artificial Sequence
  Description of Artificial Sequence: Synthetic polypeptide
  gnl|Fabrus|VH4-34_IGHD2-2*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYCSSTSCYADYFDYWGQGTLVTVSS

SEQ ID NO: 2112 - protein, 126 aa, Artificial Sequence
  Description of Artificial Sequence: Synthetic polypeptide
  gnl|Fabrus|VH4-34_IGHD3-16*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYDYVWGSYAYTDYFDYWGQGTLVTVSS

SEQ ID NO: 2113 - protein, 129 aa, Artificial Sequence
  Description of Artificial Sequence: Synthetic polypeptide
  gnl|Fabrus|VH4-34_IGHD3-22*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYYDSSGYYYDYYYYYGMDVWGQGTTVTVSS

SEQ ID NO: 2114 - protein, 119 aa, Artificial Sequence
  Description of Artificial Sequence: Synthetic polypeptide
  gnl|Fabrus|VH4-34_IGHD4-17*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGDYGDYDYFDYWGQGTLVTVSS

SEQ ID NO: 2115 - protein, 121 aa, Artificial Sequence
  Description of Artificial Sequence: Synthetic polypeptide
  gnl|Fabrus|VH4-34_IGHD5-12*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSGYDYDYFDYWGQGTLVTVSS

SEQ ID NO: 2116 - protein, 121 aa, Artificial Sequence
  Description of Artificial Sequence: Synthetic polypeptide
  gnl|Fabrus|VH4-34_IGHD6-13*01_IGHJ4*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWYDYFDYWGQGTLVTVSS

SEQ ID NO: 2117 - protein, 125 aa, Artificial Sequence
  Description of Artificial Sequence: Synthetic polypeptide
  gnl|Fabrus|VH4-34_IGHD6-25*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSGYDYYYYYGMDVWGQGTTVTVSS

SEQ ID NO: 2118 - protein, 125 aa, Artificial Sequence
  Description of Artificial Sequence: Synthetic polypeptide
  gnl|Fabrus|VH4-34_IGHD6-6*01_IGHJ6*01 Protein
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGEYSSSSDYYYYYGMDVWGQGTTVTVSS

SEQ ID NO: 2119 - protein, 122 aa, Artificial Sequence
  Description of Artificial Sequence: Synthetic polypeptide
  gnl|Fabrus|VH4-39_IGHD1-14*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNRNHAEYFQHWGQGTLVTVSS

SEQ ID NO: 2120 - protein, 126 aa, Artificial Sequence
  Description of Artificial Sequence: Synthetic polypeptide
  gnl|Fabrus|VH4-39_IGHD1-20*01_IGHJ6*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRYNWNDDYYYYYGMDVWGQGTTVTVSS

SEQ ID NO: 2121 - protein, 125 aa, Artificial Sequence
  Description of Artificial Sequence: Synthetic polypeptide
  gnl|Fabrus|VH4-39_IGHD2-21*01_IGHJ3*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQAYCGGDCYSDAFDVWGQGTMVTVSS

SEQ ID NO: 2122 - protein, 126 aa, Artificial Sequence
  Description of Artificial Sequence: Synthetic polypeptide
  gnl|Fabrus|VH4-39_IGHD3-10*01_IGHJ4*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYYGSGSYYNDYFDYWGQGTLVTVSS

SEQ ID NO: 2123 - protein, 129 aa, Artificial Sequence
  Description of Artificial Sequence: Synthetic polypeptide
  gnl|Fabrus|VH4-39_IGHD3-16*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDYVWGSYAYTYWYFDLWGRGTLVTVSS

SEQ ID NO: 2124 - protein, 131 aa, Artificial Sequence
  Description of Artificial Sequence: Synthetic polypeptide
  gnl|Fabrus|VH4-39_IGHD3-9*01_IGHJ6*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQYYDILTGYYNDYYYYYGMDVWGQGTTVTVSS

SEQ ID NO: 2125 - protein, 123 aa, Artificial Sequence
  Description of Artificial Sequence: Synthetic polypeptide
  gnl|Fabrus|VH4-39_IGHD4-23*01_IGHJ2*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHDYGGNSYWYFDLWGRGTLVTVSS

SEQ ID NO: 2126 - protein, 123 aa, Artificial Sequence
  Description of Artificial Sequence: Synthetic polypeptide
  gnl|Fabrus|VH4-39_IGHD5-12*01_IGHJ4*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRGYSGYDYDYFDYWGQGTLVTVSS

SEQ ID NO: 2127 - protein, 123 aa, Artificial Sequence
  Description of Artificial Sequence: Synthetic polypeptide
  gnl|Fabrus|VH4-39_IGHD6-6*01_IGHJ1*01 Protein
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARQEYSSSSAEYFQHWGQGTLVTVSS

SEQ ID NO: 2128 - protein, 119 aa, Artificial Sequence
  Description of Artificial Sequence: Synthetic polypeptide
  gnl|Fabrus|VH4-4_IGHD1-20*01_IGHJ3*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGYNWNDDAFDVWGQGTMVTVSS

SEQ ID NO: 2129 - protein, 124 aa, Artificial Sequence
  Description of Artificial Sequence: Synthetic polypeptide
  gnl|Fabrus|VH4-4_IGHD2-8*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREGYCTNGVCYTDYFDYWGQGTLVTVSS

SEQ ID NO: 2130 - protein, 125 aa, Artificial Sequence
  Description of Artificial Sequence: Synthetic polypeptide
  gnl|Fabrus|VH4-4_IGHD3-22*01_IGHJ2*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREYYYDSSGYYYYWYFDLWGRGTLVTVSS

SEQ ID NO: 2131 - protein, 120 aa, Artificial Sequence
  Description of Artificial Sequence: Synthetic polypeptide
  gnl|Fabrus|VH4-4_IGHD4-23*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARDDYGGNSDYFDYWGQGTLVTVSS

SEQ ID NO: 2132 - protein, 122 aa, Artificial Sequence
  Description of Artificial Sequence: Synthetic polypeptide
  gnl|Fabrus|VH4-4_IGHD5-12*01_IGHJ5*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARGGYSGYDYDNWFDSWGQGTLVTVSS

SEQ ID NO: 2133 - protein, 120 aa, Artificial Sequence
  Description of Artificial Sequence: Synthetic polypeptide
  gnl|Fabrus|VH4-4_IGHD6-6*01_IGHJ4*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAREEYSSSSDYFDYWGQGTLVTVSS

SEQ ID NO: 2134 - protein, 122 aa, Artificial Sequence
  Description of Artificial Sequence: Synthetic polypeptide
  gnl|Fabrus|VH4-4_IGHD7-27*01_IGHJ6*01 Protein
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCARANWGDYYYYYGMDVWGQGTTVTVSS

SEQ ID NO: 2135 - protein, 120 aa, Artificial Sequence
  Description of Artificial Sequence: Synthetic polypeptide
  gnl|Fabrus|VH4-59_IGHD6-25*01_IGHJ3*01 Protein
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAREGYSSGYDAFDVWGQGTMVTVSS

SEQ ID NO: 2136 - protein, 120 aa, Artificial Sequence
  Description of Artificial Sequence: Synthetic polypeptide
  gnl|Fabrus|VH5-51_IGHD1-14*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRYNRNHDYFDYWGQGTLVTVSS

SEQ ID NO: 2137 - protein, 126 aa, Artificial Sequence
  Description of Artificial Sequence: Synthetic polypeptide
  gnl|Fabrus|VH5-51_IGHD1-26*01_IGHJ6*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRYSGSYYDYYYYYGMDVWGQGTTVTVSS

SEQ ID NO: 2138 - protein, 125 aa, Artificial Sequence
  Description of Artificial Sequence: Synthetic polypeptide
  gnl|Fabrus|VH5-51_IGHD2-8*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGYCTNGVCYTDYFDYWGQGTLVTVSS

SEQ ID NO: 2139 - protein, 130 aa, Artificial Sequence
  Description of Artificial Sequence: Synthetic polypeptide
  gnl|Fabrus|VH5-51_IGHD3-10*01_IGHJ6*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQYYYGSGSYYNDYYYYYGMDVWGQGTTVTVSS

SEQ ID NO: 2140 - protein, 125 aa, Artificial Sequence
  Description of Artificial Sequence: Synthetic polypeptide
  gnl|Fabrus|VH5-51_IGHD3-3*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQYYDFWSGYYTDYFDYWGQGTLVTVSS

SEQ ID NO: 2141 - protein, 120 aa, Artificial Sequence
  Description of Artificial Sequence: Synthetic polypeptide
  gnl|Fabrus|VH5-51_IGHD4-17*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHDYGDYDYFDYWGQGTLVTVSS

SEQ ID NO: 2142 - protein, 121 aa, Artificial Sequence
  Description of Artificial Sequence: Synthetic polypeptide
  gnl|Fabrus|VH5-51_IGHD5-18*01>1_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVDTAMVNYFDYWGQGTLVTVSS

SEQ ID NO: 2143 - protein, 118 aa, Artificial Sequence
  Description of Artificial Sequence: Synthetic polypeptide
  gnl|Fabrus|VH5-51_IGHD6-25*01_IGHJ4*01 Protein
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQLTGDYFDYWGQGTLVTVSS

SEQ ID NO: 2144 - protein, 123 aa, Artificial Sequence
  Description of Artificial Sequence: Synthetic polypeptide
  gnl|Fabrus|VH6-1_IGHD1-1*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYNWNDDYFDYWGQGTLVTVSS

SEQ ID NO: 2145 - protein, 128 aa, Artificial Sequence
  Description of Artificial Sequence: Synthetic polypeptide
  gnl|Fabrus|VH6-1_IGHD1-1*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYNWNDDYYYYYGMDVWGQGTTVTVSS

SEQ ID NO: 2146 - protein, 128 aa, Artificial Sequence
  Description of Artificial Sequence: Synthetic polypeptide
  gnl|Fabrus|VH6-1_IGHD2-15*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYCSGGSCYSDYFDYWGQGTLVTVSS

SEQ ID NO: 2147 - protein, 132 aa, Artificial Sequence
  Description of Artificial Sequence: Synthetic polypeptide
  gnl|Fabrus|VH6-1_IGHD2-21*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREAYCGGDCYSDYYYYYGMDVWGQGTTVTVSS

SEQ ID NO: 2148 - protein, 131 aa, Artificial Sequence
  Description of Artificial Sequence: Synthetic polypeptide
  gnl|Fabrus|VH6-1_IGHD3-16*01_IGHJ5*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREYYDYVWGSYAYTDNWFDSWGQGTLVTVSS

SEQ ID NO: 2149 - protein, 128 aa, Artificial Sequence
  Description of Artificial Sequence: Synthetic polypeptide
  gnl|Fabrus|VH6-1_IGHD4-11*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDDYSNYDYYYYYGMDVWGQGTTVTVSS

SEQ ID NO: 2150 - protein, 124 aa, Artificial Sequence
  Description of Artificial Sequence: Synthetic polypeptide
  gnl|Fabrus|VH6-1_IGHD4-23*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDDYGGNSDYFDYWGQGTLVTVSS

SEQ ID NO: 2151 - protein, 124 aa, Artificial Sequence
  Description of Artificial Sequence: Synthetic polypeptide
  gnl|Fabrus|VH6-1_IGHD5-5*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGYSYGYDYFDYWGQGTLVTVSS

SEQ ID NO: 2152 - protein, 125 aa, Artificial Sequence
  Description of Artificial Sequence: Synthetic polypeptide
  gnl|Fabrus|VH6-1_IGHD6-13*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYSSSWYDYFDYWGQGTLVTVSS

SEQ ID NO: 2153 - protein, 129 aa, Artificial Sequence
  Description of Artificial Sequence: Synthetic polypeptide
  gnl|Fabrus|VH6-1_IGHD6-25*01_IGHJ6*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREGYSSGYDYYYYYGMDVWGQGTTVTVSS

SEQ ID NO: 2154 - protein, 121 aa, Artificial Sequence
  Description of Artificial Sequence: Synthetic polypeptide
  gnl|Fabrus|VH6-1_IGHD7-27*01_IGHJ4*01 Protein
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARANWGDYFDYWGQGTLVTVSS

SEQ ID NO: 2155 - protein, 120 aa, Artificial Sequence
  Description of Artificial Sequence: Synthetic polypeptide
  gnl|Fabrus|VH7-81_IGHD1-14*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARWYNRNHDYFDYWGQGTLVTVSS

SEQ ID NO: 2156 - protein, 125 aa, Artificial Sequence
  Description of Artificial Sequence: Synthetic polypeptide
  gnl|Fabrus|VH7-81_IGHD2-21*01_IGHJ2*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYAYCGGDCYSYWYFDLWGRGTLVTVSS

SEQ ID NO: 2157 - protein, 129 aa, Artificial Sequence
  Description of Artificial Sequence: Synthetic polypeptide
  gnl|Fabrus|VH7-81_IGHD2-21*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYAYCGGDCYSDYYYYYGMDVWGQGTTVTVSS

SEQ ID NO: 2158 - protein, 132 aa, Artificial Sequence
  Description of Artificial Sequence: Synthetic polypeptide
  gnl|Fabrus|VH7-81_IGHD3-16*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYYYDYVWGSYAYTDYYYYYGMDVWGQGTTVTVSS

SEQ ID NO: 2159 - protein, 122 aa, Artificial Sequence
  Description of Artificial Sequence: Synthetic polypeptide
  gnl|Fabrus|VH7-81_IGHD4-23*01_IGHJ1*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYDYGGNSAEYFQHWGQGTLVTVSS

SEQ ID NO: 2160 - protein, 127 aa, Artificial Sequence
  Description of Artificial Sequence: Synthetic polypeptide
  gnl|Fabrus|VH7-81_IGHD5-12*01_IGHJ6*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARCGYSGYDYDYYYYYGMDVWGQGTTVTVSS

SEQ ID NO: 2161 - protein, 121 aa, Artificial Sequence
  Description of Artificial Sequence: Synthetic polypeptide
  gnl|Fabrus|VH7-81_IGHD6-25*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARYGYSSGYDYFDYWGQGTLVTVSS

SEQ ID NO: 2162 - protein, 118 aa, Artificial Sequence
  Description of Artificial Sequence: Synthetic polypeptide
  gnl|Fabrus|VH7-81_IGHD7-27*01_IGHJ4*01 Protein
QVQLVQSGHEVKQPGASVKVSCKASGYSFTTYGMNWVPQAPGQGLEWMGWFNTYTGNPTYAQGFTGRFVFSMDTSASTAYLQISSLKAEDMAMYYCARSNWGDYFDYWGQGTLVTVSS

SEQ ID NO: 2163 - protein, 108 aa, Artificial Sequence
  Description of Artificial Sequence: Synthetic polypeptide
  gnl|Fabrus|A14_IGKJ1*01 Protein
DVVMTQSPAFLSVTPGEKVTITCQASEGIGNYLYWYQQKPDQAPKLLIKYASQSISGVPSRFSGSGSGTDFTFTISSLEAEDAATYYCQQGNKHPQWTFGQGTKVEIK

SEQ ID NO: 2164 - protein, 113 aa, Artificial Sequence
  Description of Artificial Sequence: Synthetic polypeptide
  gnl|Fabrus|A2_IGKJ1*01 Protein
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPPWTFGQGTKVEIK

SEQ ID NO: 2165 - protein, 108 aa, Artificial Sequence
  Description of Artificial Sequence: Synthetic polypeptide
  gnl|Fabrus|A20_IGKJ1*01 Protein
DIQMTQSPSSLSASVGDRVTITCRASQGISNYLAWYQQKPGKVPKLLIYAASTLQSGVPSRFSGSGSGTDFTLTISSLQPEDVATYYCQKYNSAPPWTFGQGTKVEIK

SEQ ID NO: 2166 - protein, 113 aa, Artificial Sequence
  Description of Artificial Sequence: Synthetic polypeptide
  gnl|Fabrus|A23_IGKJ1*01 Protein
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPQWTFGQGTKVEIK

SEQ ID NO: 2167 - protein, 108 aa, Artificial Sequence
  Description of Artificial Sequence: Synthetic polypeptide
  gnl|Fabrus|A26_IGKJ1*01 Protein
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPQWTFGQGTKVEIK

SEQ ID NO: 2168 - protein, 109 aa, Artificial Sequence
  Description of Artificial Sequence: Synthetic polypeptide
  gnl|Fabrus|A27_IGKJ3*01 Protein
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPFTFGPGTKVDIK

SEQ ID NO: 2169 - protein, 108 aa, Artificial Sequence
  Description of Artificial Sequence: Synthetic polypeptide
  gnl|Fabrus|A30_IGKJ1*01 Protein
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPWTFGQGTKVEIK

SEQ ID NO: 2170 - protein, 108 aa, Artificial Sequence
  Description of Artificial Sequence: Synthetic polypeptide
  gnl|Fabrus|B2_IGKJ1*01 Protein
ETTLTQSPAFMSATPGDKVNISCKASQDIDDDMNWYQQKPGEAAIFIIQEATTLVPGIPPRFSGSGYGTDFTLTINNIESEDAAYYFCLQHDNFPLWTFGQGTKVEIK

SEQ ID NO: 2171 - protein, 108 aa, Artificial Sequence
  Description of Artificial Sequence: Synthetic polypeptide
  gnl|Fabrus|B2_IGKJ3*01 Protein
ETTLTQSPAFMSATPGDKVNISCKASQDIDDDMNWYQQKPGEAAIFIIQEATTLVPGIPPRFSGSGYGTDFTLTINNIESEDAAYYFCLQHDNFPLFTFGPGTKVDIK

SEQ ID NO: 2172 - protein, 107 aa, Artificial Sequence [sequence omitted]

SEQ ID NO: 2173 - protein, 108 aa, Artificial Sequence
  Description of Artificial Sequence: Synthetic polypeptide
  gnl|Fabrus|L11_IGKJ1*01 Protein
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPPWTFGQGTKVEIK

SEQ ID NO: 2174 - protein, 108 aa, Artificial Sequence
  Description of Artificial Sequence: Synthetic polypeptide
  gnl|Fabrus|L14_IGKJ1*01 Protein
NIQMTQSPSAMSASVGDRVTITCRARQGISNYLAWFQQKPGKVPKHLIYAASSLQSGVPSRFSGSGSGTEFTLTISSLQPEDFATYYCLQHNSYPPWTFGQGTKVEIK

SEQ ID NO: 2175 - protein, 108 aa, Artificial Sequence
  Description of Artificial Sequence: Synthetic polypeptide
  gnl|Fabrus|L22_IGKJ3*01 Protein
DIQMIQSPSFLSASVGDRVSIICWASEGISSNLAWYLQKPGKSPKLFLYDAKDLHPGVSSRFSGRGSGTDFTLTIISLKPEDFAAYYCKQDFSYPPFTFGPGTKVDIK

SEQ ID NO: 2176 - protein, 108 aa, Artificial Sequence
  Description of Artificial Sequence: Synthetic polypeptide
  gnl|Fabrus|L23_IGKJ1*01 Protein
AIRMTQSPFSLSASVGDRVTITCWASQGISSYLAWYQQKPAKAPKLFIYYASSLQSGVPSRFSGSGSGTDYTLTISSLQPEDFATYYCQQYYSTPPWTFGQGTKVEIK

SEQ ID NO: 2177 - protein, 109 aa, Artificial Sequence
  Description of Artificial Sequence: Synthetic polypeptide
  gnl|Fabrus|L25_IGKJ3*01 Protein
EIVMTQSPATLSLSPGERATLSCRASQSVSSSYLSWYQQKPGQAPRLLIYGASTRATGIPARFSGSGSGTDFTLTISSLQPEDFAVYYCQQDYNLPPFTFGPGTKVDIK

SEQ ID NO: 2178 - protein, 108 aa, Artificial Sequence
  Description of Artificial Sequence: Synthetic polypeptide
  gnl|Fabrus|L4/18a_IGKJ1*01 Protein
AIQLTQSPSSLSASVGDRVTITCRASQGISSALAWYQQKPGKAPKLLIYDASSLESGVPSRFSGSGSGTDFTLTISSLQPEDFATYYCQQFNSYPQWTFGQGTKVEIK

SEQ ID NO: 2179 - protein, 108 aa, Artificial Sequence
  Description of Artificial Sequence: Synthetic polypeptide
  gnl|Fabrus|L8_IGKJ1*01 Protein
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPWTFGQGTKVEIK

SEQ ID NO: 2180 - protein, 108 aa, Artificial Sequence
  Description of Artificial Sequence: Synthetic polypeptide
  gnl|Fabrus|L9_IGKJ2*01 Protein
AIRMTQSPSSFSASTGDRVTITCRASQGISSYLAWYQQKPGKAPKLLIYAASTLQSGVPSRFSGSGSGTDFTLTISCLQSEDFATYYCQQYYSYPLYTFGQGTKLEIK

SEQ ID NO: 2181 - protein, 108 aa, Artificial Sequence
  Description of Artificial Sequence: Synthetic polypeptide
  gnl|Fabrus|O18_IGKJ1*01 Protein
DIQMTQSPSSLSASVGDRVTITCQASQDISNYLNWYQQKPGKAPKLLIYDASNLETGVPSRFSGSGSGTDFTFTISSLQPEDIATYYCQQYDNLPPWTFGQGTKVEIK

SEQ ID NO: 2182 - protein, 106 aa, Artificial Sequence
  Description of Artificial Sequence: Synthetic polypeptide
  gnl|Fabrus|Anti CD-20 LC Protein
RIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELK

SEQ ID NO: 2183 - protein, 111 aa, Artificial Sequence
  Description of Artificial Sequence: Synthetic polypeptide
  gnl|Fabrus|V1-11_IGLJ2*01 Protein
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGPVVFGGGTKLTVL

SEQ ID NO: 2184 - protein, 112 aa, Artificial Sequence
  Description of Artificial Sequence: Synthetic polypeptide
  gnl|Fabrus|V1-13_IGLJ5*01 Protein
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSWVFGEGTELTVL

SEQ ID NO: 2185 - protein, 111 aa, Artificial Sequence
  Description of Artificial Sequence: Synthetic polypeptide
  gnl|Fabrus|V1-16_IGLJ6*01 Protein
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPNVFGSGTKVTVL

SEQ ID NO: 2186 - protein, 112 aa, Artificial Sequence
  Description of Artificial Sequence: Synthetic polypeptide
  gnl|Fabrus|V1-18_IGLJ2*01 Protein
QSVLTQPPSVSGAPGQRVTISCTGSSSNIGAGYVVHWYQQLPGTAPKLLIYGNSNRPSGVPDQFSGSKSGTSASLAITGLQSEDEADYYCKAWDNSLNAHVVFGGGTKLTVL

SEQ ID NO: 2187 - protein, 111 aa, Artificial Sequence
  Description of Artificial Sequence: Synthetic polypeptide
  gnl|Fabrus|V1-2_IGLJ7*01 Protein
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNFAVFGGGTQLTVL

SEQ ID NO: 2188 - protein, 111 aa, Artificial Sequence
  Description of Artificial Sequence: Synthetic polypeptide
  gnl|Fabrus|V1-20_IGLJ6*01 Protein
QAGLTQPPSVSKGLRQTATLTCTGNSNIVGNQGAAWLQQHQGHPPKLLSYRNNNRPSGISERFSASRSGNTASLTITGLQPEDEADYYCSALDSSLSAHNVFGSGTKVTVL

SEQ ID NO: 2189 - protein, 111 aa, Artificial Sequence
  Description of Artificial Sequence: Synthetic polypeptide
  gnl|Fabrus|V1-3_IGLJ1*01 Protein
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFYVFGTGTKVTVL

SEQ ID NO: 2190 - protein, 111 aa, Artificial Sequence
  Description of Artificial Sequence: Synthetic polypeptide
  gnl|Fabrus|V1-5_IGLJ2*01 Protein
QSALTQPPSVSGSPGQSVTISCTGTSSDVGSYNRVSWYQQPPGTAPKLMIYEVSNRPSGVPDRFSGSKSGNTASLTISGLQAEDEADYYCSLYTSSSTFVVFGGGTKLTVL

SEQ ID NO: 2191 - protein, 111 aa, Artificial Sequence
  Description of Artificial Sequence: Synthetic polypeptide
  gnl|Fabrus|V1-7_IGLJ1*01 Protein
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTFYVFGTGTKVTVL

SEQ ID NO: 2192 - protein, 111 aa, Artificial Sequence
  Description of Artificial Sequence: Synthetic polypeptide
  gnl|Fabrus|V1-9_IGLJ6*01 Protein
QSALTQPPFVSGAPGQSVTISCTGTSSDVGDYDHVFWYQKRLSTTSRLLIYNVNTRPSGISDLFSGSKSGNMASLTISGLKSEVEANYHCSLYSSSYTFNVFGSGTKVTVL

SEQ ID NO: 2193 - protein, 107 aa, Artificial Sequence
  Description of Artificial Sequence: Synthetic polypeptide
  gnl|Fabrus|V2-1_IGLJ6*01 Protein
SYELTQPPSVSVSPGQTASITCSGDKLGDKYACWYQQKPGQSPVLVIYQDSKRPSGIPERFSGSNSGNTATLTISGTQAMDEADYYCQAWDSSTANVFGSGTKVTVL

SEQ ID NO: 2194 - protein, 109 aa, Artificial Sequence
  Description of Artificial Sequence: Synthetic polypeptide
  gnl|Fabrus|V2-11_IGLJ7*01 Protein
SYELTQPPSVSVSLGQMARITCSGEALPKKYAYWYQQKPGQFPVLVIYKDSERPSGIPERFSGSSSGTIVTLTISGVQAEDEADYYCLSADSSGTYPAVFGGGTQLTVL

SEQ ID NO: 2195 - protein, 109 aa, Artificial Sequence; identical to SEQ ID NO: 594
  Description of Artificial Sequence: Synthetic polypeptide
  gnl|Fabrus|V2-13_IGLJ2*01 Protein

SEQ ID NO: 2196 - protein, 109 aa, Artificial Sequence
  Description of Artificial Sequence: Synthetic polypeptide
  gnl|Fabrus|V2-14_IGLJ4*01 Protein
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHPFVFGGGTQLIIL

SEQ ID NO: 2197 - protein, 107 aa, Artificial Sequence
  Description of Artificial Sequence: Synthetic polypeptide
  gnl|Fabrus|V2-15_IGLJ7*01 Protein
SYELTQLPSVSVSPGQTARITCSGDVLGENYADWYQQKPGQAPELVIYEDSERYPGIPERFSGSTSGNTTTLTISRVLTEDEADYYCLSGDEDNPAVFGGGTQLTVL

SEQ ID NO: 2198 - protein, 109 aa, Artificial Sequence
  Description of Artificial Sequence: Synthetic polypeptide
  gnl|Fabrus|V2-17_IGLJ2*01 Protein
SYELTQPPSVSVSPGQTARITCSGDALPKQYAYWYQQKPGQAPVLVIYKDSERPSGIPERFSGSSSGTTVTLTISGVQAEDEADYYCQSADSSGTYPVVFGGGTKLTVL

SEQ ID NO: 2199 - protein, 107 aa, Artificial Sequence
  Description of Artificial Sequence: Synthetic polypeptide
  gnl|Fabrus|V2-19_IGLJ4*01 Protein
SYELTQPSSVSVSPGQTARITCSGDVLAKKYARWFQQKPGQAPVLVIYKDSERPSGIPERFSGSSSGTTVTLTISGAQVEDEADYYCYSAADNNLFVFGGGTQLIIL

SEQ ID NO: 2200 - protein, 107 aa, Artificial Sequence
  Description of Artificial Sequence: Synthetic polypeptide
  gnl|Fabrus|V2-6_IGLJ4*01 Protein
SYELTQPLSVSVALGQTARITCGGNNIGSKNVHWYQQKPGQAPVLVIYRDSNRPSGIPERFSGSNSGNTATLTISRAQAGDEADYYCQVWDSSTAFVFGGGTQLIIL

SEQ ID NO: 2201 - protein, 109 aa, Artificial Sequence
  Description of Artificial Sequence: Synthetic polypeptide
  gnl|Fabrus|V2-7_IGLJ2*01 Protein
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSVVFGGGTKLTVL

SEQ ID NO: 2202 - protein, 109 aa, Artificial Sequence
  Description of Artificial Sequence: Synthetic polypeptide
  gnl|Fabrus|V2-7_IGLJ7*01 Protein
SYELTQPPSVSVSPGQTARITCSGDALPKKYAYWYQQKSGQAPVLVIYEDSKRPSGIPERFSGSSSGTMATLTISGAQVEDEADYYCYSTDSSGNHSAVFGGGTQLTVL

SEQ ID NO: 2203 - protein, 109 aa, Artificial Sequence
  Description of Artificial Sequence: Synthetic polypeptide
  gnl|Fabrus|V2-8_IGLJ6*01 Protein
SYELTQPHSVSVATAQMARITCGGNNIGSKAVHWYQQKPGQDPVLVIYSDSNRPSGIPERFSGSNPGNTATLTISRIEAGDEADYYCQVWDSSSDHPNVFGSGTKVTVL

SEQ ID NO: 2204 - protein, 110 aa, Artificial Sequence
  Description of Artificial Sequence: Synthetic polypeptide
  gnl|Fabrus|V3-2_IGLJ4*01 Protein
QTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQFVFGGGTQLIIL

SEQ ID NO: 2205 - protein, 110 aa, Artificial Sequence
  Description of Artificial Sequence: Synthetic polypeptide
  gnl|Fabrus|V3-3_IGLJ7*01 Protein
QAVVTQEPSLTVSPGGTVTLTCGSSTGAVTSGHYPYWFQQKPGQAPRTLIYDTSNKHSWTPARFSGSLLGGKAALTLLGAQPEDEAEYYCLLSYSGARAVFGGGTQLTVL

SEQ ID NO: 2206 - protein, 116 aa, Artificial Sequence
  Description of Artificial Sequence: Synthetic polypeptide
  gnl|Fabrus|V4-1_IGLJ4*01 Protein
QPVLTQPPSSSASPGESARLTCTLPSDINVGSYNIYWYQQKPGSPPRYLLYYYSDSDKGQGSGVPSRFSGSKDASANTGILLISGLQSEDEADYYCMIWPSNASFVFGGGTQLIIL

SEQ ID NO: 2207 - protein, 116 aa, Artificial Sequence
  Description of Artificial Sequence: Synthetic polypeptide
  gnl|Fabrus|V4-2_IGLJ4*01 Protein
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASFVFGGGTQLIIL

SEQ ID NO: 2208 - protein, 118 aa, Artificial Sequence
  Description of Artificial Sequence: Synthetic polypeptide
  gnl|Fabrus|V4-4_IGLJ5*01 Protein
QPVLTQPSSHSASSGASVRLTCMLSSGFSVGDFWIRWYQQKPGNPPRYLLYYHSDSNKGQGSGVPSRFSGSNDASANAGILRISGLQPEDEADYYCGTWHSNSKTHWVFGEGTELTVL

SEQ ID NO: 2209 - protein, 112 aa, Artificial Sequence
  Description of Artificial Sequence: Synthetic polypeptide
  gnl|Fabrus|V5-4_IGLJ2*01 Protein
QPVLTQSSSASASLGSSVKLTCTLSSGHSSYIIAWHQQQPGKAPRYLMKLEGSGSYNKGSGVPDRFSGSSSGADRYLTISNLQFEDEADYYCETWDSNTHVVFGGGTKLTVL

SEQ ID NO: 2210 - protein, 112 aa, Artificial Sequence
  Description of Artificial Sequence: Synthetic polypeptide
  gnl|Fabrus|V5-6_IGLJ1*01 Protein
QLVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGIHYVFGTGTKVTVL

SEQ ID NO: 2211 - protein, 125 aa, Artificial Sequence
  Description of Artificial Sequence: Synthetic polypeptide
  VH3-23_IGHD1-1*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYAEYFQHWGQGTLVTVSSAS

SEQ ID NO: 2212 - protein, 125 aa, Artificial Sequence
  Description of Artificial Sequence: Synthetic polypeptide
  VH3-23_IGHD1-1*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYAEYFQHWGQGTLVTVSSAS

SEQ ID NO: 2213 - protein, 125 aa, Artificial Sequence
  Description of Artificial Sequence: Synthetic polypeptide
  VH3-23_IGHD1-1*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYAEYFQHWGQGTLVTVSSAS

SEQ ID NO: 2214 - protein, 125 aa, Artificial Sequence
  Description of Artificial Sequence: Synthetic polypeptide
  VH3-23_IGHD1-7*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYAEYFQHWGQGTLVTVSSAS

SEQ ID NO: 2215 - protein, 125 aa, Artificial Sequence
  Description of Artificial Sequence: Synthetic polypeptide
  VH3-23_IGHD1-7*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYAEYFQHWGQGTLVTVSSAS

SEQ ID NO: 2216 - protein, 125 aa, Artificial Sequence; identical to SEQ ID NO: 2214
  Description of Artificial Sequence: Synthetic polypeptide
  VH3-23_IGHD1-14*01>1_IGHJ1*01

SEQ ID NO: 2217 - protein, 125 aa, Artificial Sequence
  Description of Artificial Sequence: Synthetic polypeptide
  VH3-23_IGHD1-14*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYAEYFQHWGQGTLVTVSSAS

SEQ ID NO: 2218 - protein, 125 aa, Artificial Sequence; identical to SEQ ID NO: 2214
  Description of Artificial Sequence: Synthetic polypeptide
  VH3-23_IGHD1-20*01>1_IGHJ1*01

SEQ ID NO: 2219 - protein, 125 aa, Artificial Sequence; identical to SEQ ID NO: 2213
  Description of Artificial Sequence: Synthetic polypeptide
  VH3-23_IGHD1-20*01>3_IGHJ1*01

SEQ ID NO: 2220 - protein, 126 aa, Artificial Sequence
  Description of Artificial Sequence: Synthetic polypeptide
  VH3-23_IGHD1-26*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYAEYFQHWGQGTLVTVSSAS

SEQ ID NO: 2221 - protein, 126 aa, Artificial Sequence
  Description of Artificial Sequence: Synthetic polypeptide
  VH3-23_IGHD1-26*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYAEYFQHWGQGTLVTVSSAS

SEQ ID NO: 2222 - protein, 129 aa, Artificial Sequence
  Description of Artificial Sequence: Synthetic polypeptide
  VH3-23_IGHD2-2*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYAEYFQHWGQGTLVTVSSAS

SEQ ID NO: 2223 - protein, 129 aa, Artificial Sequence
  Description of Artificial Sequence: Synthetic polypeptide
  VH3-23_IGHD2-2*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYAEYFQHWGQGTLVTVSSAS

SEQ ID NO: 2224 - protein, 129 aa, Artificial Sequence
  Description of Artificial Sequence: Synthetic polypeptide
  VH3-23_IGHD2-8*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYAEYFQHWGQGTLVTVSSAS

SEQ ID NO: 2225 - protein, 129 aa, Artificial Sequence
  Description of Artificial Sequence: Synthetic polypeptide
  VH3-23_IGHD2-8*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYAEYFQHWGQGTLVTVSSAS

SEQ ID NO: 2226 - protein, 129 aa, Artificial Sequence
  Description of Artificial Sequence: Synthetic polypeptide
  VH3-23_IGHD2-15*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYAEYFQHWGQGTLVTVSSAS

SEQ ID NO: 2227 - protein, 129 aa, Artificial Sequence
  Description of Artificial Sequence: Synthetic polypeptide
  VH3-23_IGHD2-15*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYAEYFQHWGQGTLVTVSSAS

SEQ ID NO: 2228 - protein, 128 aa, Artificial Sequence
  Description of Artificial Sequence: Synthetic polypeptide
  VH3-23_IGHD2-21*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYAEYFQHWGQGTLVTVSSAS

SEQ ID NO: 2229 - protein, 128 aa, Artificial Sequence
  Description of Artificial Sequence: Synthetic polypeptide
  VH3-23_IGHD2-21*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYAEYFQHWGQGTLVTVSSAS

SEQ ID NO: 2230 - protein, 129 aa, Artificial Sequence
  Description of Artificial Sequence: Synthetic polypeptide
  VH3-23_IGHD3-3*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYAEYFQHWGQGTLVTVSSAS

SEQ ID NO: 2231 - protein, 129 aa, Artificial Sequence
  Description of Artificial Sequence: Synthetic polypeptide
  VH3-23_IGHD3-3*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYAEYFQHWGQGTLVTVSSAS

SEQ ID NO: 2232 - protein, 129 aa, Artificial Sequence
  Description of Artificial Sequence: Synthetic polypeptide
  VH3-23_IGHD3-3*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYAEYFQHWGQGTLVTVSSAS

SEQ ID NO: 2233 - protein, 129 aa, Artificial Sequence
  Description of Artificial Sequence: Synthetic polypeptide
  VH3-23_IGHD3-9*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYAEYFQHWGQGTLVTVSSAS

SEQ ID NO: 2234 - protein, 129 aa, Artificial Sequence
  Description of Artificial Sequence: Synthetic polypeptide
  VH3-23_IGHD3-10*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYAEYFQHWGQGTLVTVSSAS

SEQ ID NO: 2235 - protein, 129 aa, Artificial Sequence
  Description of Artificial Sequence: Synthetic polypeptide
  VH3-23_IGHD3-10*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYAEYFQHWGQGTLVTVSSAS

SEQ ID NO: 2236 - protein, 131 aa, Artificial Sequence
  Description of Artificial Sequence: Synthetic polypeptide
  VH3-23_IGHD3-16*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYAEYFQHWGQGTLVTVSSAS

SEQ ID NO: 2237 - protein, 131 aa, Artificial Sequence
  Description of Artificial Sequence: Synthetic polypeptide
  VH3-23_IGHD3-16*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYAEYFQHWGQGTLVTVSSAS

SEQ ID NO: 2238 - protein, 129 aa, Artificial Sequence
  Description of Artificial Sequence: Synthetic polypeptide
  VH3-23_IGHD3-22*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYAEYFQHWGQGTLVTVSSAS

SEQ ID NO: 2239 - protein, 129 aa, Artificial Sequence
  Description of Artificial Sequence: Synthetic polypeptide
  VH3-23_IGHD3-22*01>3_IGHJ1*
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYAEYFQHWGQGTLVTVSSAS

SEQ ID NO: 2240 - protein, 124 aa, Artificial Sequence
  Description of Artificial Sequence: Synthetic polypeptide
  VH3-23_IGHD4-4*01(1)_1>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYAEYFQHWGQGTLVTVSSAS

SEQ ID NO: 2241 - protein, 124 aa, Artificial Sequence
  Description of Artificial Sequence: Synthetic polypeptide
  VH3-23_IGHD4-4*01(1)_1>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYAEYFQHWGQGTLVTVSSAS

SEQ ID NO: 2242 - protein, 124 aa, Artificial Sequence; identical to SEQ ID NO: 2240
  Description of Artificial Sequence: Synthetic polypeptide
  VH3-23_IGHD4-11*01(1)_1>2_IGHJ1*01

SEQ ID NO: 2243 - protein, 124 aa, Artificial Sequence; identical to SEQ ID NO: 2241
  Description of Artificial Sequence: Synthetic polypeptide
  VH3-23_IGHD4-11*01(1)_1>3_IGHJ1*01

SEQ ID NO: 2244 - protein, 124 aa, Artificial Sequence
  Description of Artificial Sequence: Synthetic polypeptide
  VH3-23_IGHD4-17*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYAEYFQHWGQGTLVTVSSAS

SEQ ID NO: 2245 - protein, 124 aa, Artificial Sequence; identical to SEQ ID NO: 2241
  Description of Artificial Sequence: Synthetic polypeptide
  VH3-23_IGHD4-17*01>3_IGHJ1*01

SEQ ID NO: 2246 - protein, 125 aa, Artificial Sequence
  Description of Artificial Sequence: Synthetic polypeptide
  VH3-23_IGHD4-23*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYAEYFQHWGQGTLVTVSSAS

SEQ ID NO: 2247 - protein, 125 aa, Artificial Sequence
  Description of Artificial Sequence: Synthetic polypeptide
  VH3-23_IGHD4-23*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYAEYFQHWGQGTLVTVSSAS

SEQ ID NO: 2248 - protein, 126 aa, Artificial Sequence
  Description of Artificial Sequence: Synthetic polypeptide
  VH3-23_IGHD5-5*01(2)_1>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYAEYFQHWGQGTLVTVSSAS

SEQ ID NO: 2249 - protein, 126 aa, Artificial Sequence
  Description of Artificial Sequence: Synthetic polypeptide
  VH3-23_IGHD5-5*01(2)_1>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYAEYFQHWGQGTLVTVSSAS

SEQ ID NO: 2250 - protein, 126 aa, Artificial Sequence
  Description of Artificial Sequence: Synthetic polypeptide
  VH3-23_IGHD5-5*01(2)_1>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYAEYFQHWGQGTLVTVSSAS

SEQ ID NO: 2251 - protein, 127 aa, Artificial Sequence
  Description of Artificial Sequence: Synthetic polypeptide
  VH3-23_IGHD5-12*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYAEYFQHWGQGTLVTVSSAS

SEQ ID NO: 2252 - protein, 127 aa, Artificial Sequence
  Description of Artificial Sequence: Synthetic polypeptide
  VH3-23_IGHD5-12*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYAEYFQHWGQGTLVTVSSAS

SEQ ID NO: 2253 - protein, 126 aa, Artificial Sequence; identical to SEQ ID NO: 2248
  Description of Artificial Sequence: Synthetic polypeptide
  VH3-23_IGHD5-18*01(2)_1>1_IGHJ1*01

SEQ ID NO: 2254 - protein, 126 aa, Artificial Sequence; identical to SEQ ID NO: 2249
  Description of Artificial Sequence: Synthetic polypeptide
  VH3-23_IGHD5-18*01(2)_1>2_IGHJ1*01

SEQ ID NO: 2255 - protein, 126 aa, Artificial Sequence; identical to SEQ ID NO: 2250
  Description of Artificial Sequence: Synthetic polypeptide
  VH3-23_IGHD5-18*01(2)_1>3_IGHJ1*01

SEQ ID NO: 2256 - protein, 126 aa, Artificial Sequence
  Description of Artificial Sequence: Synthetic polypeptide
  VH3-23_IGHD5-24*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYAEYFQHWGQGTLVTVSSAS

SEQ ID NO: 2257 - protein, 126 aa, Artificial Sequence
  Description of Artificial Sequence: Synthetic polypeptide
  VH3-23_IGHD5-24*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYAEYFQHWGQGTLVTVSSAS

SEQ ID NO: 2258 - protein, 125 aa, Artificial Sequence
  Description of Artificial Sequence: Synthetic polypeptide
  VH3-23_IGHD6-6*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYAEYFQHWGQGTLVTVSSAS

SEQ ID NO: 2259 - protein, 125 aa, Artificial Sequence
  Description of Artificial Sequence: Synthetic polypeptide
  VH3-23_IGHD6-6*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYAEYFQHWGQGTLVTVSSAS

SEQ ID NO: 2260 - protein, 126 aa, Artificial Sequence
  Description of Artificial Sequence: Synthetic polypeptide
  VH3-23_IGHD6-13*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYAEYFQHWGQGTLVTVSSAS

SEQ ID NO: 2261 - protein, 126 aa, Artificial Sequence
  Description of Artificial Sequence: Synthetic polypeptide
  VH3-23_IGHD6-13*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYAEYFQHWGQGTLVTVSSAS

SEQ ID NO: 2262 - protein, 126 aa, Artificial Sequence
  Description of Artificial Sequence: Synthetic polypeptide
  VH3-23_IGHD6-19*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYAEYFQHWGQGTLVTVSSAS

SEQ ID NO: 2263 - protein, 126 aa, Artificial Sequence
  Description of Artificial Sequence: Synthetic polypeptide
  VH3-23_IGHD6-19*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYAEYFQHWGQGTLVTVSSAS

SEQ ID NO: 2264 - protein, 125 aa, Artificial Sequence
  Description of Artificial Sequence: Synthetic polypeptide
  VH3-23_IGHD6-25*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYAEYFQHWGQGTLVTVSSAS

SEQ ID NO: 2265 - protein, 125 aa, Artificial Sequence
  Description of Artificial Sequence: Synthetic polypeptide
  VH3-23_IGHD6-25*01>2_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYAEYFQHWGQGTLVTVSSAS

SEQ ID NO: 2266 - protein, 123 aa, Artificial Sequence
  Description of Artificial Sequence: Synthetic polypeptide
  VH3-23_IGHD7-27*01>1_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYAEYFQHWGQGTLVTVSSAS

SEQ ID NO: 2267 - protein, 123 aa, Artificial Sequence
  Description of Artificial Sequence: Synthetic polypeptide
  VH3-23_IGHD7-27*01>3_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYAEYFQHWGQGTLVTVSSAS

SEQ ID NO: 2268 - protein, 125 aa, Artificial Sequence
  Description of Artificial Sequence: Synthetic polypeptide
  VH3-23_IGHD1-1*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYAEYFQHWGQGTLVTVSSAS

SEQ ID NO: 2269 - protein, 125 aa, Artificial Sequence
  Description of Artificial Sequence: Synthetic polypeptide
  VH3-23_IGHD1-1*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYAEYFQHWGQGTLVTVSSAS

SEQ ID NO: 2270 - protein, 125 aa, Artificial Sequence
  Description of Artificial Sequence: Synthetic polypeptide
  VH3-23_IGHD1-1*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYAEYFQHWGQGTLVTVSSAS

SEQ ID NO: 2271 - protein, 125 aa, Artificial Sequence
  Description of Artificial Sequence: Synthetic polypeptide
  VH3-23_IGHD1-7*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYAEYFQHWGQGTLVTVSSAS

SEQ ID NO: 2272 - protein, 125 aa, Artificial Sequence
  Description of Artificial Sequence: Synthetic polypeptide
  VH3-23_IGHD1-7*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYAEYFQHWGQGTLVTVSSAS

SEQ ID NO: 2273 - protein, 125 aa, Artificial Sequence; identical to SEQ ID NO: 2271
  Description of Artificial Sequence: Synthetic polypeptide
  VH3-23_IGHD1-14*01>1'_IGHJ1*01

SEQ ID NO: 2274 - protein, 125 aa, Artificial Sequence
  Description of Artificial Sequence: Synthetic polypeptide
  VH3-23_IGHD1-14*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYAEYFQHWGQGTLVTVSSAS

SEQ ID NO: 2275 - protein, 125 aa, Artificial Sequence
  Description of Artificial Sequence: Synthetic polypeptide
  VH3-23_IGHD1-14*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYAEYFQHWGQGTLVTVSSAS

SEQ ID NO: 2276 - protein, 125 aa, Artificial Sequence; identical to SEQ ID NO: 2271
  Description of Artificial Sequence: Synthetic polypeptide
  VH3-23_IGHD1-20*01>1'_IGHJ1*01

SEQ ID NO: 2277 - protein, 125 aa, Artificial Sequence; identical to SEQ ID NO: 2269
  Description of Artificial Sequence: Synthetic polypeptide
  VH3-23_IGHD1-20*01>2'_IGHJ1*01

SEQ ID NO: 2278 - protein, 125 aa, Artificial Sequence
  Description of Artificial Sequence: Synthetic polypeptide
  VH3-23_IGHD1-20*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYAEYFQHWGQGTLVTVSSAS

SEQ ID NO: 2279 - protein, 126 aa, Artificial Sequence
  Description of Artificial Sequence: Synthetic polypeptide
  VH3-23_IGHD1-26*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYAEYFQHWGQGTLVTVSSAS

SEQ ID NO: 2280 - protein, 126 aa, Artificial Sequence
  Description of Artificial Sequence: Synthetic polypeptide
  VH3-23_IGHD1-26*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYAEYFQHWGQGTLVTVSSAS

SEQ ID NO: 2281 - protein, 129 aa, Artificial Sequence
  Description of Artificial Sequence: Synthetic polypeptide
  VH3-23_IGHD2-2*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYAEYFQHWGQGTLVTVSSAS

SEQ ID NO: 2282 - protein, 129 aa, Artificial Sequence
  Description of Artificial Sequence: Synthetic polypeptide
  VH3-23_IGHD2-2*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYAEYFQHWGQGTLVTVSSAS

SEQ ID NO: 2283 - protein, 129 aa, Artificial Sequence
  Description of Artificial Sequence: Synthetic polypeptide
  VH3-23_IGHD2-8*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYAEYFQHWGQGTLVTVSSAS

SEQ ID NO: 2284 - protein, 129 aa, Artificial Sequence
  Description of Artificial Sequence: Synthetic polypeptide
  VH3-23_IGHD2-15*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYAEYFQHWGQGTLVTVSSAS

SEQ ID NO: 2285 - protein, 129 aa, Artificial Sequence
  Description of Artificial Sequence: Synthetic polypeptide
  VH3-23_IGHD2-15*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYAEYFQHWGQGTLVTVSSAS

SEQ ID NO: 2286 - protein, 128 aa, Artificial Sequence
  Description of Artificial Sequence: Synthetic polypeptide
  VH3-23_IGHD2-21*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYAEYFQHWGQGTLVTVSSAS

SEQ ID NO: 2287 - protein, 128 aa, Artificial Sequence
  Description of Artificial Sequence: Synthetic polypeptide
  VH3-23_IGHD2-21*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYAEYFQHWGQGTLVTVSSAS

SEQ ID NO: 2288 - protein, 129 aa, Artificial Sequence
  Description of Artificial Sequence: Synthetic polypeptide
  VH3-23_IGHD3-3*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYAEYFQHWGQGTLVTVSSAS

SEQ ID NO: 2289 - protein, 129 aa, Artificial Sequence
  Description of Artificial Sequence: Synthetic polypeptide
  VH3-23_IGHD3-3*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYAEYFQHWGQGTLVTVSSAS

SEQ ID NO: 2290 - protein, 129 aa, Artificial Sequence
  Description of Artificial Sequence: Synthetic polypeptide
  VH3-23_IGHD3-9*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYAEYFQHWGQGTLVTVSSAS

SEQ ID NO: 2291 - protein, 129 aa, Artificial Sequence
  Description of Artificial Sequence: Synthetic polypeptide
  VH3-23_IGHD3-9*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYAEYFQHWGQGTLVTVSSAS

SEQ ID NO: 2292 - protein, 129 aa, Artificial Sequence
  Description of Artificial Sequence: Synthetic polypeptide
  VH3-23_IGHD3-10*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYAEYFQHWGQGTLVTVSSAS

SEQ ID NO: 2293 - protein, 129 aa, Artificial Sequence
  Description of Artificial Sequence: Synthetic polypeptide
  VH3-23_IGHD3-10*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYAEYFQHWGQGTLVTVSSAS

SEQ ID NO: 2294 - protein, 131 aa, Artificial Sequence
  Description of Artificial Sequence: Synthetic polypeptide
  VH3-23_IGHD3-16*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYAEYFQHWGQGTLVTVSSAS

SEQ ID NO: 2295 - protein, 131 aa, Artificial Sequence
  Description of Artificial Sequence: Synthetic polypeptide
  VH3-23_IGHD3-16*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYAEYFQHWGQGTLVTVSSAS

SEQ ID NO: 2296 - protein, 129 aa, Artificial Sequence
  Description of Artificial Sequence: Synthetic polypeptide
  VH3-23_IGHD3-22*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYAEYFQHWGQGTLVTVSSAS

SEQ ID NO: 2297 - protein, 124 aa, Artificial Sequence
  Description of Artificial Sequence: Synthetic polypeptide
  VH3-23_IGHD4-4*01(1)_1>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYAEYFQHWGQGTLVTVSSAS

SEQ ID NO: 2298 - protein, 124 aa, Artificial Sequence
  Description of Artificial Sequence: Synthetic polypeptide
  VH3-23_IGHD4-4*01(1)_1>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYAEYFQHWGQGTLVTVSSAS

SEQ ID NO: 2299 - protein, 124 aa, Artificial Sequence; identical to SEQ ID NO: 2297
  Description of Artificial Sequence: Synthetic polypeptide
  VH3-23_IGHD4-11*01(1)_1>1'_IGHJ1*01

SEQ ID NO: 2300 - protein, 124 aa, Artificial Sequence; identical to SEQ ID NO: 2298
  Description of Artificial Sequence: Synthetic polypeptide
  VH3-23_IGHD4-11*01(1)_1>3'_IGHJ1*01

SEQ ID NO: 2301 - protein, 124 aa, Artificial Sequence; identical to SEQ ID NO: 2297
  Description of Artificial Sequence: Synthetic polypeptide
  VH3-23_IGHD4-17*01>1'_IGHJ1*01

SEQ ID NO: 2302 - protein, 124 aa, Artificial Sequence
  Description of Artificial Sequence: Synthetic polypeptide
  VH3-23_IGHD4-17*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYAEYFQHWGQGTLVTVSSAS

SEQ ID NO: 2303 - protein, 125 aa, Artificial Sequence
  Description of Artificial Sequence: Synthetic polypeptide
  VH3-23_IGHD4-23*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYAEYFQHWGQGTLVTVSSAS

SEQ ID NO: 2304 - protein, 125 aa, Artificial Sequence
  Description of Artificial Sequence: Synthetic polypeptide
  VH3-23_IGHD4-23*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYAEYFQHWGQGTLVTVSSAS

SEQ ID NO: 2305 - protein, 126 aa, Artificial Sequence
  Description of Artificial Sequence: Synthetic polypeptide
  VH3-23_IGHD5-5*01(2)_1>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYAEYFQHWGQGTLVTVSSAS

SEQ ID NO: 2306 - protein, 126 aa, Artificial Sequence
  Description of Artificial Sequence: Synthetic polypeptide
  VH3-23_IGHD5-5*01(2)_1>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYAEYFQHWGQGTLVTVSSAS

SEQ ID NO: 2307 - protein, 127 aa, Artificial Sequence
  Description of Artificial Sequence: Synthetic polypeptide
  VH3-23_IGHD5-12*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYAEYFQHWGQGTLVTVSSAS

SEQ ID NO: 2308 - protein, 127 aa, Artificial Sequence
  Description of Artificial Sequence: Synthetic polypeptide
  VH3-23_IGHD5-12*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYAEYFQHWGQGTLVTVSSAS

SEQ ID NO: 2309 - protein, 126 aa, Artificial Sequence; identical to SEQ ID NO: 2305
  Description of Artificial Sequence: Synthetic polypeptide
  VH3-23_IGHD5-18*01(2)_1>1'_IGHJ1*01

SEQ ID NO: 2310 - protein, 126 aa, Artificial Sequence; identical to SEQ ID NO: 2306
  Description of Artificial Sequence: Synthetic polypeptide
  VH3-23_IGHD5-18*01(2)_1>3'_IGHJ1*01

SEQ ID NO: 2311 - protein, 126 aa, Artificial Sequence
  Description of Artificial Sequence: Synthetic polypeptide
  VH3-23_IGHD5-24*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYAEYFQHWGQGTLVTVSSAS

SEQ ID NO: 2312 - protein, 126 aa, Artificial Sequence
  Description of Artificial Sequence: Synthetic polypeptide
  VH3-23_IGHD5-24*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYAEYFQHWGQGTLVTVSSAS

SEQ ID NO: 2313 - protein, 125 aa, Artificial Sequence
  Description of Artificial Sequence: Synthetic polypeptide
  VH3-23_IGHD6-6*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYAEYFQHWGQGTLVTVSSAS

SEQ ID NO: 2314 - protein, 125 aa, Artificial Sequence
  Description of Artificial Sequence: Synthetic polypeptide
  VH3-23_IGHD6-6*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYAEYFQHWGQGTLVTVSSAS

SEQ ID NO: 2315 - protein, 125 aa, Artificial Sequence
  Description of Artificial Sequence: Synthetic polypeptide
  VH3-23_IGHD6-6*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYAEYFQHWGQGTLVTVSSAS

SEQ ID NO: 2316 - protein, 126 aa, Artificial Sequence
  Description of Artificial Sequence: Synthetic polypeptide
  VH3-23_IGHD6-13*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYAEYFQHWGQGTLVTVSSAS

SEQ ID NO: 2317 - protein, 126 aa, Artificial Sequence
  Description of Artificial Sequence: Synthetic polypeptide
  VH3-23_IGHD6-13*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYAEYFQHWGQGTLVTVSSAS

SEQ ID NO: 2318 - protein, 126 aa, Artificial Sequence
  Description of Artificial Sequence: Synthetic polypeptide
  VH3-23_IGHD6-13*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYAEYFQHWGQGTLVTVSSAS

SEQ ID NO: 2319 - protein, 126 aa, Artificial Sequence
  Description of Artificial Sequence: Synthetic polypeptide
  VH3-23_IGHD6-19*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYAEYFQHWGQGTLVTVSSAS

SEQ ID NO: 2320 - protein, 126 aa, Artificial Sequence
  Description of Artificial Sequence: Synthetic polypeptide
  VH3-23_IGHD6-19*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYAEYFQHWGQGTLVTVSSAS

SEQ ID NO: 2321 - protein, 126 aa, Artificial Sequence
  Description of Artificial Sequence: Synthetic polypeptide
  VH3-23_IGHD6-19*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYAEYFQHWGQGTLVTVSSAS

SEQ ID NO: 2322 - protein, 125 aa, Artificial Sequence
  Description of Artificial Sequence: Synthetic polypeptide
  VH3-23_IGHD6-25*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYAEYFQHWGQGTLVTVSSAS

SEQ ID NO: 2323 - protein, 125 aa, Artificial Sequence
  Description of Artificial Sequence: Synthetic polypeptide
  VH3-23_IGHD6-25*01>3'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYAEYFQHWGQGTLVTVSSAS

SEQ ID NO: 2324 - protein, 123 aa, Artificial Sequence
  Description of Artificial Sequence: Synthetic polypeptide
  VH3-23_IGHD7-27*01>1'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYAEYFQHWGQGTLVTVSSAS

SEQ ID NO: 2325 - protein, 123 aa, Artificial Sequence
  Description of Artificial Sequence: Synthetic polypeptide
  VH3-23_IGHD7-27*01>2'_IGHJ1*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYAEYFQHWGQGTLVTVSSAS

SEQ ID NO: 2326 - protein, 125 aa, Artificial Sequence
  Description of Artificial Sequence: Synthetic polypeptide
  VH3-23_IGHD1-1*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYWYFDSWGQGTLVTVSSAS

SEQ ID NO: 2327 - protein, 125 aa, Artificial Sequence
  Description of Artificial Sequence: Synthetic polypeptide
  VH3-23_IGHD1-1*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYWYFDSWGQGTLVTVSSAS

SEQ ID NO: 2328 - protein, 125 aa, Artificial Sequence
  Description of Artificial Sequence: Synthetic polypeptide
  VH3-23_IGHD1-1*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYWYFDSWGQGTLVTVSSAS

SEQ ID NO: 2329 - protein, 125 aa, Artificial Sequence
  Description of Artificial Sequence: Synthetic polypeptide
  VH3-23_IGHD1-7*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYWYFDSWGQGTLVTVSSAS

SEQ ID NO: 2330 - protein, 125 aa, Artificial Sequence
  Description of Artificial Sequence: Synthetic polypeptide
  VH3-23_IGHD1-7*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYWYFDSWGQGTLVTVSSAS

SEQ ID NO: 2331 - protein, 125 aa, Artificial Sequence; identical to SEQ ID NO: 2329
  Description of Artificial Sequence: Synthetic polypeptide
  VH3-23_IGHD1-14*01>1_IGHJ2*01

SEQ ID NO: 2332 - protein, 125 aa, Artificial Sequence
  Description of Artificial Sequence: Synthetic polypeptide
  VH3-23_IGHD1-14*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYWYFDSWGQGTLVTVSSAS

SEQ ID NO: 2333 - protein, 125 aa, Artificial Sequence; identical to SEQ ID NO: 2329
  Description of Artificial Sequence: Synthetic polypeptide
  VH3-23_IGHD1-20*01>1_IGHJ2*01

SEQ ID NO: 2334 - protein, 125 aa, Artificial Sequence; identical to SEQ ID NO: 2328
  Description of Artificial Sequence: Synthetic polypeptide
  VH3-23_IGHD1-20*01>3_IGHJ2*01

SEQ ID NO: 2335 - protein, 126 aa, Artificial Sequence
  Description of Artificial Sequence: Synthetic polypeptide
  VH3-23_IGHD1-26*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYWYFDSWGQGTLVTVSSAS

SEQ ID NO: 2336 - protein, 126 aa, Artificial Sequence
  Description of Artificial Sequence: Synthetic polypeptide
  VH3-23_IGHD1-26*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYWYFDSWGQGTLVTVSSAS

SEQ ID NO: 2337 - protein, 129 aa, Artificial Sequence
  Description of Artificial Sequence: Synthetic polypeptide
  VH3-23_IGHD2-2*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYWYFDSWGQGTLVTVSSAS

SEQ ID NO: 2338 - protein, 129 aa, Artificial Sequence
  Description of Artificial Sequence: Synthetic polypeptide
  VH3-23_IGHD2-2*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYWYFDSWGQGTLVTVSSAS

SEQ ID NO: 2339 - protein, 129 aa, Artificial Sequence
  Description of Artificial Sequence: Synthetic polypeptide
  VH3-23_IGHD2-8*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYWYFDSWGQGTLVTVSSAS

SEQ ID NO: 2340 - protein, 129 aa, Artificial Sequence
  Description of Artificial Sequence: Synthetic polypeptide
  VH3-23_IGHD2-8*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYWYFDSWGQGTLVTVSSAS

SEQ ID NO: 2341 - protein, 129 aa, Artificial Sequence
  Description of Artificial Sequence: Synthetic polypeptide
  VH3-23_IGHD2-15*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYWYFDSWGQGTLVTVSSAS

SEQ ID NO: 2342 - protein, 129 aa, Artificial Sequence
  Description of Artificial Sequence: Synthetic polypeptide
  VH3-23_IGHD2-15*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYWYFDSWGQGTLVTVSSAS

SEQ ID NO: 2343 - protein, 128 aa, Artificial Sequence
  Description of Artificial Sequence: Synthetic polypeptide
  VH3-23_IGHD2-21*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYWYFDSWGQGTLVTVSSAS

SEQ ID NO: 2344 - protein, 128 aa, Artificial Sequence
  Description of Artificial Sequence: Synthetic polypeptide
  VH3-23_IGHD2-21*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYWYFDSWGQGTLVTVSSAS

SEQ ID NO: 2345 - protein, 129 aa, Artificial Sequence
  Description of Artificial Sequence: Synthetic polypeptide
  VH3-23_IGHD3-3*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYWYFDSWGQGTLVTVSSAS

SEQ ID NO: 2346 - protein, 129 aa, Artificial Sequence
  Description of Artificial Sequence: Synthetic polypeptide
  VH3-23_IGHD3-3*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYWYFDSWGQGTLVTVSSAS

SEQ ID NO: 2347 - protein, 129 aa, Artificial Sequence
  Description of Artificial Sequence: Synthetic polypeptide
  VH3-23_IGHD3-3*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYWYFDSWGQGTLVTVSSAS

SEQ ID NO: 2348 - protein, 129 aa, Artificial Sequence
  Description of Artificial Sequence: Synthetic polypeptide
  VH3-23_IGHD3-9*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYWYFDSWGQGTLVTVSSAS

SEQ ID NO: 2349 - protein, 129 aa, Artificial Sequence
  Description of Artificial Sequence: Synthetic polypeptide
  VH3-23_IGHD3-10*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYWYFDSWGQGTLVTVSSAS

SEQ ID NO: 2350 - protein, 129 aa, Artificial Sequence
  Description of Artificial Sequence: Synthetic polypeptide
  VH3-23_IGHD3-10*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYWYFDSWGQGTLVTVSSAS

SEQ ID NO: 2351 - protein, 131 aa, Artificial Sequence
  Description of Artificial Sequence: Synthetic polypeptide
  VH3-23_IGHD3-16*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYWYFDSWGQGTLVTVSSAS

SEQ ID NO: 2352 - protein, 131 aa, Artificial Sequence
  Description of Artificial Sequence: Synthetic polypeptide
  VH3-23_IGHD3-16*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYWYFDSWGQGTLVTVSSAS

SEQ ID NO: 2353 - protein, 129 aa, Artificial Sequence
  Description of Artificial Sequence: Synthetic polypeptide
  VH3-23_IGHD3-22*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYWYFDSWGQGTLVTVSSAS

SEQ ID NO: 2354 - protein, 129 aa, Artificial Sequence
  Description of Artificial Sequence: Synthetic polypeptide
  VH3-23_IGHD3-22*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYWYFDSWGQGTLVTVSSAS

SEQ ID NO: 2355 - protein, 124 aa, Artificial Sequence
  Description of Artificial Sequence: Synthetic polypeptide
  VH3-23_IGHD4-4*01(1)_1>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYWYFDSWGQGTLVTVSSAS

SEQ ID NO: 2356 - protein, 124 aa, Artificial Sequence
  Description of Artificial Sequence: Synthetic polypeptide
  VH3-23_IGHD4-4*01(1)_1>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYWYFDSWGQGTLVTVSSAS

SEQ ID NO: 2357 - protein, 124 aa, Artificial Sequence; identical to SEQ ID NO: 2355
  Description of Artificial Sequence: Synthetic polypeptide
  VH3-23_IGHD4-11*01(1)_1>2_IGHJ2*01

SEQ ID NO: 2358 - protein, 124 aa, Artificial Sequence; identical to SEQ ID NO: 2356
  Description of Artificial Sequence: Synthetic polypeptide
  VH3-23_IGHD4-11*01(1)_1>3_IGHJ2*01

SEQ ID NO: 2359 - protein, 124 aa, Artificial Sequence
  Description of Artificial Sequence: Synthetic polypeptide
  VH3-23_IGHD4-17*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYWYFDSWGQGTLVTVSSAS

SEQ ID NO: 2360 - protein, 124 aa, Artificial Sequence; identical to SEQ ID NO: 2356
  Description of Artificial Sequence: Synthetic polypeptide
  VH3-23_IGHD4-17*01>3_IGHJ2*01

SEQ ID NO: 2361 - protein, 125 aa, Artificial Sequence
  Description of Artificial Sequence: Synthetic polypeptide
  VH3-23_IGHD4-23*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYWYFDSWGQGTLVTVSSAS

SEQ ID NO: 2362 - protein, 125 aa, Artificial Sequence
  Description of Artificial Sequence: Synthetic polypeptide
  VH3-23_IGHD4-23*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYWYFDSWGQGTLVTVSSAS

SEQ ID NO: 2363 - protein, 126 aa, Artificial Sequence
  Description of Artificial Sequence: Synthetic polypeptide
  VH3-23_IGHD5-5*01(2)_1>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYWYFDSWGQGTLVTVSSAS

SEQ ID NO: 2364 - protein, 126 aa, Artificial Sequence
  Description of Artificial Sequence: Synthetic polypeptide
  VH3-23_IGHD5-5*01(2)_1>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYWYFDSWGQGTLVTVSSAS

SEQ ID NO: 2365 - protein, 126 aa, Artificial Sequence
  Description of Artificial Sequence: Synthetic polypeptide
  VH3-23_IGHD5-5*01(2)_1>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYWYFDSWGQGTLVTVSSAS

SEQ ID NO: 2366 - protein, 127 aa, Artificial Sequence
  Description of Artificial Sequence: Synthetic polypeptide
  VH3-23_IGHD5-12*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYWYFDSWGQGTLVTVSSAS

SEQ ID NO: 2367 - protein, 127 aa, Artificial Sequence
  Description of Artificial Sequence: Synthetic polypeptide
  VH3-23_IGHD5-12*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYWYFDSWGQGTLVTVSSAS

SEQ ID NO: 2368 - protein, 126 aa, Artificial Sequence; identical to SEQ ID NO: 2363
  Description of Artificial Sequence: Synthetic polypeptide
  VH3-23_IGHD5-18*01(2)_1>1_IGHJ2*01

SEQ ID NO: 2369 - protein, 126 aa, Artificial Sequence; identical to SEQ ID NO: 2364
  Description of Artificial Sequence: Synthetic polypeptide
  VH3-23_IGHD5-18*01(2)_1>2_IGHJ2*01

SEQ ID NO: 2370 - protein, 126 aa, Artificial Sequence; identical to SEQ ID NO: 2365
  Description of Artificial Sequence: Synthetic polypeptide
  VH3-23_IGHD5-18*01(2)_1>3_IGHJ2*01

SEQ ID NO: 2371 - protein, 126 aa, Artificial Sequence
  Description of Artificial Sequence: Synthetic polypeptide
  VH3-23_IGHD5-24*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYWYFDSWGQGTLVTVSSAS

SEQ ID NO: 2372 - protein, 126 aa, Artificial Sequence
  Description of Artificial Sequence: Synthetic polypeptide
  VH3-23_IGHD5-24*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYWYFDSWGQGTLVTVSSAS

SEQ ID NO: 2373 - protein, 125 aa, Artificial Sequence
  Description of Artificial Sequence: Synthetic polypeptide
  VH3-23_IGHD6-6*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYWYFDSWGQGTLVTVSSAS

SEQ ID NO: 2374 - protein, 125 aa, Artificial Sequence
  Description of Artificial Sequence: Synthetic polypeptide
  VH3-23_IGHD6-6*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYWYFDSWGQGTLVTVSSAS

SEQ ID NO: 2375 - protein, 126 aa, Artificial Sequence
  Description of Artificial Sequence: Synthetic polypeptide
  VH3-23_IGHD6-13*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYWYFDSWGQGTLVTVSSAS

SEQ ID NO: 2376 - protein, 126 aa, Artificial Sequence
  Description of Artificial Sequence: Synthetic polypeptide
  VH3-23_IGHD6-13*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYWYFDSWGQGTLVTVSSAS

SEQ ID NO: 2377 - protein, 126 aa, Artificial Sequence
  Description of Artificial Sequence: Synthetic polypeptide
  VH3-23_IGHD6-19*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYWYFDSWGQGTLVTVSSAS

SEQ ID NO: 2378 - protein, 126 aa, Artificial Sequence
  Description of Artificial Sequence: Synthetic polypeptide
  VH3-23_IGHD6-19*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYWYFDSWGQGTLVTVSSAS

SEQ ID NO: 2379 - protein, 125 aa, Artificial Sequence
  Description of Artificial Sequence: Synthetic polypeptide
  VH3-23_IGHD6-25*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYWYFDSWGQGTLVTVSSAS

SEQ ID NO: 2380 - protein, 125 aa, Artificial Sequence
  Description of Artificial Sequence: Synthetic polypeptide
  VH3-23_IGHD6-25*01>2_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYWYFDSWGQGTLVTVSSAS

SEQ ID NO: 2381 - protein, 123 aa, Artificial Sequence
  Description of Artificial Sequence: Synthetic polypeptide
  VH3-23_IGHD7-27*01>1_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYWYFDSWGQGTLVTVSSAS

SEQ ID NO: 2382 - protein, 123 aa, Artificial Sequence
  Description of Artificial Sequence: Synthetic polypeptide
  VH3-23_IGHD7-27*01>3_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYWYFDSWGQGTLVTVSSAS

SEQ ID NO: 2383 - protein, 125 aa, Artificial Sequence
  Description of Artificial Sequence: Synthetic polypeptide
  VH3-23_IGHD1-1*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYWYFDSWGQGTLVTVSSAS

SEQ ID NO: 2384 - protein, 125 aa, Artificial Sequence
  Description of Artificial Sequence: Synthetic polypeptide
  VH3-23_IGHD1-1*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYWYFDSWGQGTLVTVSSAS

SEQ ID NO: 2385 - protein, 125 aa, Artificial Sequence
  Description of Artificial Sequence: Synthetic polypeptide
  VH3-23_IGHD1-1*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYWYFDSWGQGTLVTVSSAS

SEQ ID NO: 2386 - protein, 125 aa, Artificial Sequence
  Description of Artificial Sequence: Synthetic polypeptide
  VH3-23_IGHD1-7*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYWYFDSWGQGTLVTVSSAS

SEQ ID NO: 2387 - protein, 125 aa, Artificial Sequence
  Description of Artificial Sequence: Synthetic polypeptide
  VH3-23_IGHD1-7*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYWYFDSWGQGTLVTVSSAS

SEQ ID NO: 2388 - protein, 125 aa, Artificial Sequence; identical to SEQ ID NO: 2386
  Description of Artificial Sequence: Synthetic polypeptide
  VH3-23_IGHD1-14*01>1'_IGHJ2*01

SEQ ID NO: 2389 - protein, 125 aa, Artificial Sequence
  Description of Artificial Sequence: Synthetic polypeptide
  VH3-23_IGHD1-14*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYWYFDSWGQGTLVTVSSAS

SEQ ID NO: 2390 - protein, 125 aa, Artificial Sequence
  Description of Artificial Sequence: Synthetic polypeptide
  VH3-23_IGHD1-14*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYWYFDSWGQGTLVTVSSAS

SEQ ID NO: 2391 - protein, 125 aa, Artificial Sequence; identical to SEQ ID NO: 2386
  Description of Artificial Sequence: Synthetic polypeptide
  VH3-23_IGHD1-20*01>1'_IGHJ2*01

SEQ ID NO: 2392 - protein, 125 aa, Artificial Sequence; identical to SEQ ID NO: 2384
  Description of Artificial Sequence: Synthetic polypeptide
  VH3-23_IGHD1-20*01>2'_IGHJ2*01

SEQ ID NO: 2393 - protein, 125 aa, Artificial Sequence
  Description of Artificial Sequence: Synthetic polypeptide
  VH3-23_IGHD1-20*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYWYFDSWGQGTLVTVSSAS

SEQ ID NO: 2394 - protein, 126 aa, Artificial Sequence
  Description of Artificial Sequence: Synthetic polypeptide
  VH3-23_IGHD1-26*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYWYFDSWGQGTLVTVSSAS

SEQ ID NO: 2395 - protein, 126 aa, Artificial Sequence
  Description of Artificial Sequence: Synthetic polypeptide
  VH3-23_IGHD1-26*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYWYFDSWGQGTLVTVSSAS

SEQ ID NO: 2396 - protein, 129 aa, Artificial Sequence
  Description of Artificial Sequence: Synthetic polypeptide
  VH3-23_IGHD2-2*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYWYFDSWGQGTLVTVSSAS

SEQ ID NO: 2397 - protein, 129 aa, Artificial Sequence
  Description of Artificial Sequence: Synthetic polypeptide
  VH3-23_IGHD2-2*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYWYFDSWGQGTLVTVSSAS

SEQ ID NO: 2398 - protein, 129 aa, Artificial Sequence
  Description of Artificial Sequence: Synthetic polypeptide
  VH3-23_IGHD2-8*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYWYFDSWGQGTLVTVSSAS

SEQ ID NO: 2399 - protein, 129 aa, Artificial Sequence
  Description of Artificial Sequence: Synthetic polypeptide
  VH3-23_IGHD2-15*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYWYFDSWGQGTLVTVSSAS

SEQ ID NO: 2400 - protein, 129 aa, Artificial Sequence
  Description of Artificial Sequence: Synthetic polypeptide
  VH3-23_IGHD2-15*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYWYFDSWGQGTLVTVSSAS

SEQ ID NO: 2401 - protein, 128 aa, Artificial Sequence
  Description of Artificial Sequence: Synthetic polypeptide
  VH3-23_IGHD2-21*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYWYFDSWGQGTLVTVSSAS

SEQ ID NO: 2402 - protein, 128 aa, Artificial Sequence
  Description of Artificial Sequence: Synthetic polypeptide
  VH3-23_IGHD2-21*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYWYFDSWGQGTLVTVSSAS

SEQ ID NO: 2403 - protein, 129 aa, Artificial Sequence
  Description of Artificial Sequence: Synthetic polypeptide
  VH3-23_IGHD3-3*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYWYFDSWGQGTLVTVSSAS

SEQ ID NO: 2404 - protein, 129 aa, Artificial Sequence
  Description of Artificial Sequence: Synthetic polypeptide
  VH3-23_IGHD3-3*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYWYFDSWGQGTLVTVSSAS

SEQ ID NO: 2405 - protein, 129 aa, Artificial Sequence
  Description of Artificial Sequence: Synthetic polypeptide
  VH3-23_IGHD3-9*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYWYFDSWGQGTLVTVSSAS

SEQ ID NO: 2406 - protein, 129 aa, Artificial Sequence
  Description of Artificial Sequence: Synthetic polypeptide
  VH3-23_IGHD3-9*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYWYFDSWGQGTLVTVSSAS

SEQ ID NO: 2407 - protein, 129 aa, Artificial Sequence
  Description of Artificial Sequence: Synthetic polypeptide
  VH3-23_IGHD3-10*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYWYFDSWGQGTLVTVSSAS

SEQ ID NO: 2408 - protein, 129 aa, Artificial Sequence
  Description of Artificial Sequence: Synthetic polypeptide
  VH3-23_IGHD3-10*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYWYFDSWGQGTLVTVSSAS

SEQ ID NO: 2409 - protein, 131 aa, Artificial Sequence
  Description of Artificial Sequence: Synthetic polypeptide
  VH3-23_IGHD3-16*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYWYFDSWGQGTLVTVSSAS

SEQ ID NO: 2410 - protein, 131 aa, Artificial Sequence
  Description of Artificial Sequence: Synthetic polypeptide
  VH3-23_IGHD3-16*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYWYFDSWGQGTLVTVSSAS

SEQ ID NO: 2411 - protein, 129 aa, Artificial Sequence
  Description of Artificial Sequence: Synthetic polypeptide
  VH3-23_IGHD3-22*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYWYFDSWGQGTLVTVSSAS

SEQ ID NO: 2412 - protein, 124 aa, Artificial Sequence
  Description of Artificial Sequence: Synthetic polypeptide
  VH3-23_IGHD4-4*01(1)_1>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYWYFDSWGQGTLVTVSSAS

SEQ ID NO: 2413 - protein, 124 aa, Artificial Sequence
  Description of Artificial Sequence: Synthetic polypeptide
  VH3-23_IGHD4-4*01(1)_1>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYWYFDSWGQGTLVTVSSAS

SEQ ID NO: 2414 - protein, 124 aa, Artificial Sequence; identical to SEQ ID NO: 2412
  Description of Artificial Sequence: Synthetic polypeptide
  VH3-23_IGHD4-11*01(1)_1>1'_IGHJ2*01

SEQ ID NO: 2415 - protein, 124 aa, Artificial Sequence; identical to SEQ ID NO: 2413
  Description of Artificial Sequence: Synthetic polypeptide
  VH3-23_IGHD4-11*01(1)_1>3'_IGHJ2*01

SEQ ID NO: 2416 - protein, 124 aa, Artificial Sequence; identical to SEQ ID NO: 2412
  Description of Artificial Sequence: Synthetic polypeptide
  VH3-23_IGHD4-17*01>1'_IGHJ2*01

SEQ ID NO: 2417 - protein, 124 aa, Artificial Sequence
  Description of Artificial Sequence: Synthetic polypeptide
  VH3-23_IGHD4-17*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYWYFDSWGQGTLVTVSSAS

SEQ ID NO: 2418 - protein, 125 aa, Artificial Sequence
  Description of Artificial Sequence: Synthetic polypeptide
  VH3-23_IGHD4-23*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYWYFDSWGQGTLVTVSSAS

SEQ ID NO: 2419 - protein, 125 aa, Artificial Sequence
  Description of Artificial Sequence: Synthetic polypeptide
  VH3-23_IGHD4-23*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYWYFDSWGQGTLVTVSSAS

SEQ ID NO: 2420 - protein, 126 aa, Artificial Sequence
  Description of Artificial Sequence: Synthetic polypeptide
  VH3-23_IGHD5-5*01(2)_1>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYWYFDSWGQGTLVTVSSAS

SEQ ID NO: 2421 - protein, 126 aa, Artificial Sequence
  Description of Artificial Sequence: Synthetic polypeptide
  VH3-23_IGHD5-5*01(2)_1>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYWYFDSWGQGTLVTVSSAS

SEQ ID NO: 2422 - protein, 127 aa, Artificial Sequence
  Description of Artificial Sequence: Synthetic polypeptide
  VH3-23_IGHD5-12*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYWYFDSWGQGTLVTVSSAS

SEQ ID NO: 2423 - protein, 127 aa, Artificial Sequence
  Description of Artificial Sequence: Synthetic polypeptide
  VH3-23_IGHD5-12*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYWYFDSWGQGTLVTVSSAS

SEQ ID NO: 2424 - protein, 126 aa, Artificial Sequence; identical to SEQ ID NO: 2420
  Description of Artificial Sequence: Synthetic polypeptide
  VH3-23_IGHD5-18*01(2)_1>1'_IGHJ2*01

SEQ ID NO: 2425 - protein, 126 aa, Artificial Sequence; identical to SEQ ID NO: 2421
  Description of Artificial Sequence: Synthetic polypeptide
  VH3-23_IGHD5-18*01(2)_1>3'_IGHJ2*01

SEQ ID NO: 2426 - protein, 126 aa, Artificial Sequence
  Description of Artificial Sequence: Synthetic polypeptide
  VH3-23_IGHD5-24*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYWYFDSWGQGTLVTVSSAS

SEQ ID NO: 2427 - protein, 126 aa, Artificial Sequence
  Description of Artificial Sequence: Synthetic polypeptide
  VH3-23_IGHD5-24*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYWYFDSWGQGTLVTVSSAS

SEQ ID NO: 2428 - protein, 125 aa, Artificial Sequence
  Description of Artificial Sequence: Synthetic polypeptide
  VH3-23_IGHD6-6*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYWYFDSWGQGTLVTVSSAS

SEQ ID NO: 2429 - protein, 125 aa, Artificial Sequence
  Description of Artificial Sequence: Synthetic polypeptide
  VH3-23_IGHD6-6*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYWYFDSWGQGTLVTVSSAS

SEQ ID NO: 2430 - protein, 125 aa, Artificial Sequence
  Description of Artificial Sequence: Synthetic polypeptide
  VH3-23_IGHD6-6*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYWYFDSWGQGTLVTVSSAS

SEQ ID NO: 2431 - protein, 126 aa, Artificial Sequence
  Description of Artificial Sequence: Synthetic polypeptide
  VH3-23_IGHD6-13*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYWYFDSWGQGTLVTVSSAS

SEQ ID NO: 2432 - protein, 126 aa, Artificial Sequence
  Description of Artificial Sequence: Synthetic polypeptide
  VH3-23_IGHD6-13*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYWYFDSWGQGTLVTVSSAS

SEQ ID NO: 2433 - protein, 126 aa, Artificial Sequence
  Description of Artificial Sequence: Synthetic polypeptide
  VH3-23_IGHD6-13*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYWYFDSWGQGTLVTVSSAS

SEQ ID NO: 2434 - protein, 126 aa, Artificial Sequence
  Description of Artificial Sequence: Synthetic polypeptide
  VH3-23_IGHD6-19*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYWYFDSWGQGTLVTVSSAS

SEQ ID NO: 2435 - protein, 126 aa, Artificial Sequence
  Description of Artificial Sequence: Synthetic polypeptide
  VH3-23_IGHD6-19*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYWYFDSWGQGTLVTVSSAS

SEQ ID NO: 2436 - protein, 126 aa, Artificial Sequence
  Description of Artificial Sequence: Synthetic polypeptide
  VH3-23_IGHD6-19*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYWYFDSWGQGTLVTVSSAS

SEQ ID NO: 2437 - protein, 125 aa, Artificial Sequence
  Description of Artificial Sequence: Synthetic polypeptide
  VH3-23_IGHD6-25*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYWYFDSWGQGTLVTVSSAS

SEQ ID NO: 2438 - protein, 125 aa, Artificial Sequence
  Description of Artificial Sequence: Synthetic polypeptide
  VH3-23_IGHD6-25*01>3'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYWYFDSWGQGTLVTVSSAS

SEQ ID NO: 2439 - protein, 123 aa, Artificial Sequence
  Description of Artificial Sequence: Synthetic polypeptide
  VH3-23_IGHD7-27*01>1'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYWYFDSWGQGTLVTVSSAS

SEQ ID NO: 2440 - protein, 123 aa, Artificial Sequence
  Description of Artificial Sequence: Synthetic polypeptide
  VH3-23_IGHD7-27*01>2'_IGHJ2*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYWYFDSWGQGTLVTVSSAS

SEQ ID NO: 2441 - protein, 123 aa, Artificial Sequence
  Description of Artificial Sequence: Synthetic polypeptide
  VH3-23_IGHD1-1*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYAFDVWGQGTLVTVSSAS

SEQ ID NO: 2442 - protein, 123 aa, Artificial Sequence
  Description of Artificial Sequence: Synthetic polypeptide
  VH3-23_IGHD1-1*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYAFDVWGQGTLVTVSSAS

SEQ ID NO: 2443 - protein, 123 aa, Artificial Sequence
  Description of Artificial Sequence: Synthetic polypeptide
  VH3-23_IGHD1-1*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYAFDVWGQGTLVTVSSAS

SEQ ID NO: 2444 - protein, 123 aa, Artificial Sequence
  Description of Artificial Sequence: Synthetic polypeptide
  VH3-23_IGHD1-7*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYAFDVWGQGTLVTVSSAS

SEQ ID NO: 2445 - protein, 123 aa, Artificial Sequence
  Description of Artificial Sequence: Synthetic polypeptide
  VH3-23_IGHD1-7*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYAFDVWGQGTLVTVSSAS

SEQ ID NO: 2446 - protein, 123 aa, Artificial Sequence; identical to SEQ ID NO: 2444
  Description of Artificial Sequence: Synthetic polypeptide
  VH3-23_IGHD1-14*01>1_IGHJ3*01

SEQ ID NO: 2447 - protein, 123 aa, Artificial Sequence
  Description of Artificial Sequence: Synthetic polypeptide
  VH3-23_IGHD1-14*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYAFDVWGQGTLVTVSSAS

SEQ ID NO: 2448 - protein, 123 aa, Artificial Sequence; identical to SEQ ID NO: 2444
  Description of Artificial Sequence: Synthetic polypeptide
  VH3-23_IGHD1-20*01>1_IGHJ3*01

SEQ ID NO: 2449 - protein, 123 aa, Artificial Sequence; identical to SEQ ID NO: 2443
  Description of Artificial Sequence: Synthetic polypeptide
  VH3-23_IGHD1-20*01>3_IGHJ3*01

SEQ ID NO: 2450 - protein, 124 aa, Artificial Sequence
  Description of Artificial Sequence: Synthetic polypeptide
  VH3-23_IGHD1-26*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYAFDVWGQGTLVTVSSAS

SEQ ID NO: 2451 - protein, 124 aa, Artificial Sequence
  Description of Artificial Sequence: Synthetic polypeptide
  VH3-23_IGHD1-26*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYAFDVWGQGTLVTVSSAS

SEQ ID NO: 2452 - protein, 127 aa, Artificial Sequence
  Description of Artificial Sequence: Synthetic polypeptide
  VH3-23_IGHD2-2*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYAFDVWGQGTLVTVSSAS

SEQ ID NO: 2453 - protein, 127 aa, Artificial Sequence
  Description of Artificial Sequence: Synthetic polypeptide
  VH3-23_IGHD2-2*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYAFDVWGQGTLVTVSSAS

SEQ ID NO: 2454 - protein, 127 aa, Artificial Sequence
  Description of Artificial Sequence: Synthetic polypeptide
  VH3-23_IGHD2-8*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYAFDVWGQGTLVTVSSAS

SEQ ID NO: 2455 - protein, 127 aa, Artificial Sequence
  Description of Artificial Sequence: Synthetic polypeptide
  VH3-23_IGHD2-8*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYAFDVWGQGTLVTVSSAS

SEQ ID NO: 2456 - protein, 127 aa, Artificial Sequence
  Description of Artificial Sequence: Synthetic polypeptide
  VH3-23_IGHD2-15*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYAFDVWGQGTLVTVSSAS

SEQ ID NO: 2457 - protein, 127 aa, Artificial Sequence
  Description of Artificial Sequence: Synthetic polypeptide
  VH3-23_IGHD2-15*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYAFDVWGQGTLVTVSSAS

SEQ ID NO: 2458 - protein, 126 aa, Artificial Sequence
  Description of Artificial Sequence: Synthetic polypeptide
  VH3-23_IGHD2-21*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYAFDVWGQGTLVTVSSAS

SEQ ID NO: 2459 - protein, 126 aa, Artificial Sequence
  Description of Artificial Sequence: Synthetic polypeptide
  VH3-23_IGHD2-21*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYAFDVWGQGTLVTVSSAS

SEQ ID NO: 2460 - protein, 127 aa, Artificial Sequence
  Description of Artificial Sequence: Synthetic polypeptide
  VH3-23_IGHD3-3*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYAFDVWGQGTLVTVSSAS

SEQ ID NO: 2461 - protein, 127 aa, Artificial Sequence
  Description of Artificial Sequence: Synthetic polypeptide
  VH3-23_IGHD3-3*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYAFDVWGQGTLVTVSSAS

SEQ ID NO: 2462 - protein, 127 aa, Artificial Sequence
  Description of Artificial Sequence: Synthetic polypeptide
  VH3-23_IGHD3-3*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYAFDVWGQGTLVTVSSAS

SEQ ID NO: 2463 - protein, 127 aa, Artificial Sequence
  Description of Artificial Sequence: Synthetic polypeptide
  VH3-23_IGHD3-9*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYAFDVWGQGTLVTVSSAS

SEQ ID NO: 2464 - protein, 127 aa, Artificial Sequence
  Description of Artificial Sequence: Synthetic polypeptide
  VH3-23_IGHD3-10*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYAFDVWGQGTLVTVSSAS

SEQ ID NO: 2465 - protein, 127 aa, Artificial Sequence
  Description of Artificial Sequence: Synthetic polypeptide
  VH3-23_IGHD3-10*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYAFDVWGQGTLVTVSSAS

SEQ ID NO: 2466 - protein, 129 aa, Artificial Sequence
  Description of Artificial Sequence: Synthetic polypeptide
  VH3-23_IGHD3-16*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYAFDVWGQGTLVTVSSAS

SEQ ID NO: 2467 - protein, 129 aa, Artificial Sequence
  Description of Artificial Sequence: Synthetic polypeptide
  VH3-23_IGHD3-16*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYAFDVWGQGTLVTVSSAS

SEQ ID NO: 2468 - protein, 127 aa, Artificial Sequence
  Description of Artificial Sequence: Synthetic polypeptide
  VH3-23_IGHD3-22*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYAFDVWGQGTLVTVSSAS

SEQ ID NO: 2469 - protein, 127 aa, Artificial Sequence
  Description of Artificial Sequence: Synthetic polypeptide
  VH3-23_IGHD3-22*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYAFDVWGQGTLVTVSSAS

SEQ ID NO: 2470 - protein, 122 aa, Artificial Sequence
  Description of Artificial Sequence: Synthetic polypeptide
  VH3-23_IGHD4-4*01(1)_1>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYAFDVWGQGTLVTVSSAS

SEQ ID NO: 2471 - protein, 122 aa, Artificial Sequence
  Description of Artificial Sequence: Synthetic polypeptide
  VH3-23_IGHD4-4*01(1)_1>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYAFDVWGQGTLVTVSSAS

SEQ ID NO: 2472 - protein, 122 aa, Artificial Sequence; identical to SEQ ID NO: 2470
  Description of Artificial Sequence: Synthetic polypeptide
  VH3-23_IGHD4-11*01(1)_1>2_IGHJ3*01

SEQ ID NO: 2473 - protein, 122 aa, Artificial Sequence; identical to SEQ ID NO: 2471
  Description of Artificial Sequence: Synthetic polypeptide
  VH3-23_IGHD4-11*01(1)_1>3_IGHJ3*01

SEQ ID NO: 2474 - protein, 122 aa, Artificial Sequence
  Description of Artificial Sequence: Synthetic polypeptide
  VH3-23_IGHD4-17*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYAFDVWGQGTLVTVSSAS

SEQ ID NO: 2475 - protein, 122 aa, Artificial Sequence; identical to SEQ ID NO: 2471
  Description of Artificial Sequence: Synthetic polypeptide
  VH3-23_IGHD4-17*01>3_IGHJ3*01

SEQ ID NO: 2476 - protein, 123 aa, Artificial Sequence
  Description of Artificial Sequence: Synthetic polypeptide
  VH3-23_IGHD4-23*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYAFDVWGQGTLVTVSSAS

SEQ ID NO: 2477 - protein, 123 aa, Artificial Sequence
  Description of Artificial Sequence: Synthetic polypeptide
  VH3-23_IGHD4-23*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYAFDVWGQGTLVTVSSAS

SEQ ID NO: 2478 - protein, 124 aa, Artificial Sequence
  Description of Artificial Sequence: Synthetic polypeptide
  VH3-23_IGHD5-5*01(2)_1>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYAFDVWGQGTLVTVSSAS

SEQ ID NO: 2479 - protein, 124 aa, Artificial Sequence
  Description of Artificial Sequence: Synthetic polypeptide
  VH3-23_IGHD5-5*01(2)_1>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYAFDVWGQGTLVTVSSAS

SEQ ID NO: 2480 - protein, 124 aa, Artificial Sequence
  Description of Artificial Sequence: Synthetic polypeptide
  VH3-23_IGHD5-5*01(2)_1>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYAFDVWGQGTLVTVSSAS

SEQ ID NO: 2481 - protein, 125 aa, Artificial Sequence
  Description of Artificial Sequence: Synthetic polypeptide
  VH3-23_IGHD5-12*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYAFDVWGQGTLVTVSSAS

SEQ ID NO: 2482 - protein, 125 aa, Artificial Sequence
  Description of Artificial Sequence: Synthetic polypeptide
  VH3-23_IGHD5-12*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYAFDVWGQGTLVTVSSAS

SEQ ID NO: 2483 - protein, 124 aa, Artificial Sequence; identical to SEQ ID NO: 2478
  Description of Artificial Sequence: Synthetic polypeptide
  VH3-23_IGHD5-18*01(2)_1>1_IGHJ3*01

SEQ ID NO: 2484 - protein, 124 aa, Artificial Sequence; identical to SEQ ID NO: 2479
  Description of Artificial Sequence: Synthetic polypeptide
  VH3-23_IGHD5-18*01(2)_1>2_IGHJ3*01

SEQ ID NO: 2485 - protein, 124 aa, Artificial Sequence; identical to SEQ ID NO: 2480
  Description of Artificial Sequence: Synthetic polypeptide
  VH3-23_IGHD5-18*01(2)_1>3_IGHJ3*01

SEQ ID NO: 2486 - protein, 124 aa, Artificial Sequence
  Description of Artificial Sequence: Synthetic polypeptide
  VH3-23_IGHD5-24*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYAFDVWGQGTLVTVSSAS

SEQ ID NO: 2487 - protein, 124 aa, Artificial Sequence
  Description of Artificial Sequence: Synthetic polypeptide
  VH3-23_IGHD5-24*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYAFDVWGQGTLVTVSSAS

SEQ ID NO: 2488 - protein, 123 aa, Artificial Sequence
  Description of Artificial Sequence: Synthetic polypeptide
  VH3-23_IGHD6-6*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYAFDVWGQGTLVTVSSAS

SEQ ID NO: 2489 - protein, 123 aa, Artificial Sequence
  Description of Artificial Sequence: Synthetic polypeptide
  VH3-23_IGHD6-6*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYAFDVWGQGTLVTVSSAS

SEQ ID NO: 2490 - protein, 124 aa, Artificial Sequence
  Description of Artificial Sequence: Synthetic polypeptide
  VH3-23_IGHD6-13*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYAFDVWGQGTLVTVSSAS

SEQ ID NO: 2491 - protein, 124 aa, Artificial Sequence
  Description of Artificial Sequence: Synthetic polypeptide
  VH3-23_IGHD6-13*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYAFDVWGQGTLVTVSSAS

SEQ ID NO: 2492 - protein, 124 aa, Artificial Sequence
  Description of Artificial Sequence: Synthetic polypeptide
  VH3-23_IGHD6-19*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYAFDVWGQGTLVTVSSAS

SEQ ID NO: 2493 - protein, 124 aa, Artificial Sequence
  Description of Artificial Sequence: Synthetic polypeptide
  VH3-23_IGHD6-19*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYAFDVWGQGTLVTVSSAS

SEQ ID NO: 2494 - protein, 123 aa, Artificial Sequence
  Description of Artificial Sequence: Synthetic polypeptide
  VH3-23_IGHD6-25*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYAFDVWGQGTLVTVSSAS

SEQ ID NO: 2495 - protein, 123 aa, Artificial Sequence
  Description of Artificial Sequence: Synthetic polypeptide
  VH3-23_IGHD6-25*01>2_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYAFDVWGQGTLVTVSSAS

SEQ ID NO: 2496 - protein, 121 aa, Artificial Sequence
  Description of Artificial Sequence: Synthetic polypeptide
  VH3-23_IGHD7-27*01>1_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYAFDVWGQGTLVTVSSAS

SEQ ID NO: 2497 - protein, 121 aa, Artificial Sequence
  Description of Artificial Sequence: Synthetic polypeptide
  VH3-23_IGHD7-27*01>3_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYAFDVWGQGTLVTVSSAS

SEQ ID NO: 2498 - protein, 123 aa, Artificial Sequence
  Description of Artificial Sequence: Synthetic polypeptide
  VH3-23_IGHD1-1*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYAFDVWGQGTLVTVSSAS

SEQ ID NO: 2499 - protein, 123 aa, Artificial Sequence
  Description of Artificial Sequence: Synthetic polypeptide
  VH3-23_IGHD1-1*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYAFDVWGQGTLVTVSSAS

SEQ ID NO: 2500 - protein, 123 aa, Artificial Sequence
  Description of Artificial Sequence: Synthetic polypeptide
  VH3-23_IGHD1-1*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYAFDVWGQGTLVTVSSAS

SEQ ID NO: 2501 - protein, 123 aa, Artificial Sequence
  Description of Artificial Sequence: Synthetic polypeptide
  VH3-23_IGHD1-7*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYAFDVWGQGTLVTVSSAS

SEQ ID NO: 2502 - protein, 123 aa, Artificial Sequence
  Description of Artificial Sequence: Synthetic polypeptide
  VH3-23_IGHD1-7*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYAFDVWGQGTLVTVSSAS

SEQ ID NO: 2503 - protein, 123 aa, Artificial Sequence; identical to SEQ ID NO: 2501
  Description of Artificial Sequence: Synthetic polypeptide
  VH3-23_IGHD1-14*01>1'_IGHJ3*01

SEQ ID NO: 2504 - protein, 123 aa, Artificial Sequence
  Description of Artificial Sequence: Synthetic polypeptide
  VH3-23_IGHD1-14*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYAFDVWGQGTLVTVSSAS

SEQ ID NO: 2505 - protein, 123 aa, Artificial Sequence
  Description of Artificial Sequence: Synthetic polypeptide
  VH3-23_IGHD1-14*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYAFDVWGQGTLVTVSSAS

SEQ ID NO: 2506 - protein, 123 aa, Artificial Sequence; identical to SEQ ID NO: 2501
  Description of Artificial Sequence: Synthetic polypeptide
  VH3-23_IGHD1-20*01>1'_IGHJ3*01

SEQ ID NO: 2507 - protein, 123 aa, Artificial Sequence; identical to SEQ ID NO: 2499
  Description of Artificial Sequence: Synthetic polypeptide
  VH3-23_IGHD1-20*01>2'_IGHJ3*01

SEQ ID NO: 2508 - protein, 123 aa, Artificial Sequence
  Description of Artificial Sequence: Synthetic polypeptide
  VH3-23_IGHD1-20*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYAFDVWGQGTLVTVSSAS

SEQ ID NO: 2509 - protein, 124 aa, Artificial Sequence
  Description of Artificial Sequence: Synthetic polypeptide
  VH3-23_IGHD1-26*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYAFDVWGQGTLVTVSSAS

SEQ ID NO: 2510 - protein, 124 aa, Artificial Sequence
  Description of Artificial Sequence: Synthetic polypeptide
  VH3-23_IGHD1-26*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYAFDVWGQGTLVTVSSAS

SEQ ID NO: 2511 - protein, 127 aa, Artificial Sequence
  Description of Artificial Sequence: Synthetic polypeptide
  VH3-23_IGHD2-2*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYAFDVWGQGTLVTVSSAS

SEQ ID NO: 2512 - protein, 127 aa, Artificial Sequence
  Description of Artificial Sequence: Synthetic polypeptide
  VH3-23_IGHD2-2*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYAFDVWGQGTLVTVSSAS

SEQ ID NO: 2513 - protein, 127 aa, Artificial Sequence
  Description of Artificial Sequence: Synthetic polypeptide
  VH3-23_IGHD2-8*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYAFDVWGQGTLVTVSSAS

SEQ ID NO: 2514 - protein, 127 aa, Artificial Sequence
  Description of Artificial Sequence: Synthetic polypeptide
  VH3-23_IGHD2-15*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYAFDVWGQGTLVTVSSAS

SEQ ID NO: 2515 - protein, 127 aa, Artificial Sequence
  Description of Artificial Sequence: Synthetic polypeptide
  VH3-23_IGHD2-15*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYAFDVWGQGTLVTVSSAS

SEQ ID NO: 2516 - protein, 126 aa, Artificial Sequence
  Description of Artificial Sequence: Synthetic polypeptide
  VH3-23_IGHD2-21*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYAFDVWGQGTLVTVSSAS

SEQ ID NO: 2517 - protein, 126 aa, Artificial Sequence
  Description of Artificial Sequence: Synthetic polypeptide
  VH3-23_IGHD2-21*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYAFDVWGQGTLVTVSSAS

SEQ ID NO: 2518 - protein, 127 aa, Artificial Sequence
  Description of Artificial Sequence: Synthetic polypeptide
  VH3-23_IGHD3-3*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYAFDVWGQGTLVTVSSAS

SEQ ID NO: 2519 - protein, 127 aa, Artificial Sequence
  Description of Artificial Sequence: Synthetic polypeptide
  VH3-23_IGHD3-3*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYAFDVWGQGTLVTVSSAS

SEQ ID NO: 2520 - protein, 127 aa, Artificial Sequence
  Description of Artificial Sequence: Synthetic polypeptide
  VH3-23_IGHD3-9*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYAFDVWGQGTLVTVSSAS

SEQ ID NO: 2521 - protein, 127 aa, Artificial Sequence
  Description of Artificial Sequence: Synthetic polypeptide
  B12_VH3-23_IGHD3-9*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYAFDVWGQGTLVTVSSAS

SEQ ID NO: 2522 - protein, 127 aa, Artificial Sequence
  Description of Artificial Sequence: Synthetic polypeptide
  VH3-23_IGHD3-10*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYAFDVWGQGTLVTVSSAS

SEQ ID NO: 2523 - protein, 129 aa, Artificial Sequence
  Description of Artificial Sequence: Synthetic polypeptide
  VH3-23_IGHD3-16*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYAFDVWGQGTLVTVSSAS

SEQ ID NO: 2524 - protein, 129 aa, Artificial Sequence
  Description of Artificial Sequence: Synthetic polypeptide
  VH3-23_IGHD3-16*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYAFDVWGQGTLVTVSSAS

SEQ ID NO: 2525 - protein, 127 aa, Artificial Sequence
  Description of Artificial Sequence: Synthetic polypeptide
  VH3-23_IGHD3-22*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYAFDVWGQGTLVTVSSAS

SEQ ID NO: 2526 - protein, 122 aa, Artificial Sequence
  Description of Artificial Sequence: Synthetic polypeptide
  VH3-23_IGHD4-4*01(1)_1>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYAFDVWGQGTLVTVSSAS

SEQ ID NO: 2527 - protein, 122 aa, Artificial Sequence
  Description of Artificial Sequence: Synthetic polypeptide
  VH3-23_IGHD4-4*01(1)_1>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYAFDVWGQGTLVTVSSAS

SEQ ID NO: 2528 - protein, 122 aa, Artificial Sequence; identical to SEQ ID NO: 2526
  Description of Artificial Sequence: Synthetic polypeptide
  VH3-23_IGHD4-11*01(1)_1>1'_IGHJ3*01

SEQ ID NO: 2529 - protein, 122 aa, Artificial Sequence; identical to SEQ ID NO: 2527
  Description of Artificial Sequence: Synthetic polypeptide
  VH3-23_IGHD4-11*01(1)_1>3'_IGHJ3*01

SEQ ID NO: 2530 - protein, 122 aa, Artificial Sequence; identical to SEQ ID NO: 2526
  Description of Artificial Sequence: Synthetic polypeptide
  VH3-23_IGHD4-17*01>1'_IGHJ3*01

SEQ ID NO: 2531 - protein, 122 aa, Artificial Sequence
  Description of Artificial Sequence: Synthetic polypeptide
  VH3-23_IGHD4-17*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYAFDVWGQGTLVTVSSAS

SEQ ID NO: 2532 - protein, 123 aa, Artificial Sequence
  Description of Artificial Sequence: Synthetic polypeptide
  VH3-23_IGHD4-23*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYAFDVWGQGTLVTVSSAS

SEQ ID NO: 2533 - protein, 123 aa, Artificial Sequence
  Description of Artificial Sequence: Synthetic polypeptide
  VH3-23_IGHD4-23*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYAFDVWGQGTLVTVSSAS

SEQ ID NO: 2534 - protein, 124 aa, Artificial Sequence
  Description of Artificial Sequence: Synthetic polypeptide
  VH3-23_IGHD5-5*01(2)_1>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYAFDVWGQGTLVTVSSAS

SEQ ID NO: 2535 - protein, 124 aa, Artificial Sequence
  Description of Artificial Sequence: Synthetic polypeptide
  VH3-23_IGHD5-5*01(2)_1>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYAFDVWGQGTLVTVSSAS

SEQ ID NO: 2536 - protein, 125 aa, Artificial Sequence
  Description of Artificial Sequence: Synthetic polypeptide
  VH3-23_IGHD5-12*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYAFDVWGQGTLVTVSSAS

SEQ ID NO: 2537 - protein, 125 aa, Artificial Sequence
  Description of Artificial Sequence: Synthetic polypeptide
  VH3-23_IGHD5-12*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYAFDVWGQGTLVTVSSAS

SEQ ID NO: 2538 - protein, 124 aa, Artificial Sequence; identical to SEQ ID NO: 2534
  Description of Artificial Sequence: Synthetic polypeptide
  VH3-23_IGHD5-18*01(2)_1>1'_IGHJ3*01

SEQ ID NO: 2539 - protein, 124 aa, Artificial Sequence; identical to SEQ ID NO: 2535
  Description of Artificial Sequence: Synthetic polypeptide
  VH3-23_IGHD5-18*01(2)_1>3'_IGHJ3*

SEQ ID NO: 2540 - protein, 124 aa, Artificial Sequence
  Description of Artificial Sequence: Synthetic polypeptide
  VH3-23_IGHD5-24*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYAFDVWGQGTLVTVSSAS

SEQ ID NO: 2541 - protein, 124 aa, Artificial Sequence
  Description of Artificial Sequence: Synthetic polypeptide
  VH3-23_IGHD5-24*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYAFDVWGQGTLVTVSSAS

SEQ ID NO: 2542 - protein, 123 aa, Artificial Sequence
  Description of Artificial Sequence: Synthetic polypeptide
  VH3-23_IGHD6-6*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYAFDVWGQGTLVTVSSAS

SEQ ID NO: 2543 - protein, 123 aa, Artificial Sequence
  Description of Artificial Sequence: Synthetic polypeptide
  VH3-23_IGHD6-6*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYAFDVWGQGTLVTVSSAS

SEQ ID NO: 2544 - protein, 123 aa, Artificial Sequence
  Description of Artificial Sequence: Synthetic polypeptide
  VH3-23_IGHD6-6*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYAFDVWGQGTLVTVSSAS

SEQ ID NO: 2545 - protein, 124 aa, Artificial Sequence
  Description of Artificial Sequence: Synthetic polypeptide
  VH3-23_IGHD6-13*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYAFDVWGQGTLVTVSSAS

SEQ ID NO: 2546 - protein, 124 aa, Artificial Sequence
  Description of Artificial Sequence: Synthetic polypeptide
  VH3-23_IGHD6-13*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYAFDVWGQGTLVTVSSAS

SEQ ID NO: 2547 - protein, 124 aa, Artificial Sequence
  Description of Artificial Sequence: Synthetic polypeptide
  VH3-23_IGHD6-13*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYAFDVWGQGTLVTVSSAS

SEQ ID NO: 2548 - protein, 124 aa, Artificial Sequence
  Description of Artificial Sequence: Synthetic polypeptide
  VH3-23_IGHD6-19*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYAFDVWGQGTLVTVSSAS

SEQ ID NO: 2549 - protein, 124 aa, Artificial Sequence
  Description of Artificial Sequence: Synthetic polypeptide
  VH3-23_IGHD6-19*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYAFDVWGQGTLVTVSSAS

SEQ ID NO: 2550 - protein, 124 aa, Artificial Sequence
  Description of Artificial Sequence: Synthetic polypeptide
  VH3-23_IGHD6-19*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYAFDVWGQGTLVTVSSAS

SEQ ID NO: 2551 - protein, 123 aa, Artificial Sequence
  Description of Artificial Sequence: Synthetic polypeptide
  VH3-23_IGHD6-25*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYAFDVWGQGTLVTVSSAS

SEQ ID NO: 2552 - protein, 123 aa, Artificial Sequence
  Description of Artificial Sequence: Synthetic polypeptide
  VH3-23_IGHD6-25*01>3'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYAFDVWGQGTLVTVSSAS

SEQ ID NO: 2553 - protein, 121 aa, Artificial Sequence
  Description of Artificial Sequence: Synthetic polypeptide
  VH3-23_IGHD7-27*01>1'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYAFDVWGQGTLVTVSSAS

SEQ ID NO: 2554 - protein, 121 aa, Artificial Sequence
  Description of Artificial Sequence: Synthetic polypeptide
  VH3-23_IGHD7-27*01>2'_IGHJ3*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYAFDVWGQGTLVTVSSAS

SEQ ID NO: 2555 - protein, 123 aa, Artificial Sequence
  Description of Artificial Sequence: Synthetic polypeptide
  VH3-23_IGHD1-1*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYFDYWGQGTLVTVSSAS

SEQ ID NO: 2556 - protein, 123 aa, Artificial Sequence
  Description of Artificial Sequence: Synthetic polypeptide
  VH3-23_IGHD1-1*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYFDYWGQGTLVTVSSAS

SEQ ID NO: 2557 - protein, 123 aa, Artificial Sequence
  Description of Artificial Sequence: Synthetic polypeptide
  VH3-23_IGHD1-1*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYFDYWGQGTLVTVSSAS

SEQ ID NO: 2558 - protein, 123 aa, Artificial Sequence
  Description of Artificial Sequence: Synthetic polypeptide
  VH3-23_IGHD1-7*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYFDYWGQGTLVTVSSAS

SEQ ID NO: 2559 - protein, 123 aa, Artificial Sequence
  Description of Artificial Sequence: Synthetic polypeptide
  VH3-23_IGHD1-7*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYFDYWGQGTLVTVSSAS

SEQ ID NO: 2560 - protein, 123 aa, Artificial Sequence; identical to SEQ ID NO: 2558
  Description of Artificial Sequence: Synthetic polypeptide
  VH3-23_IGHD1-14*01>1_IGHJ4*01

SEQ ID NO: 2561 - protein, 123 aa, Artificial Sequence
  Description of Artificial Sequence: Synthetic polypeptide
  VH3-23_IGHD1-14*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYFDYWGQGTLVTVSSAS

SEQ ID NO: 2562 - protein, 123 aa, Artificial Sequence; identical to SEQ ID NO: 2558
  Description of Artificial Sequence: Synthetic polypeptide
  VH3-23_IGHD1-20*01>1_IGHJ4*01

SEQ ID NO: 2563 - protein, 123 aa, Artificial Sequence; identical to SEQ ID NO: 2557
  Description of Artificial Sequence: Synthetic polypeptide
  VH3-23_IGHD1-20*01>3_IGHJ4*01

SEQ ID NO: 2564 - protein, 124 aa, Artificial Sequence
  Description of Artificial Sequence: Synthetic polypeptide
  VH3-23_IGHD1-26*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYFDYWGQGTLVTVSSAS

SEQ ID NO: 2565 - protein, 124 aa, Artificial Sequence
  Description of Artificial Sequence: Synthetic polypeptide
  VH3-23_IGHD1-26*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYFDYWGQGTLVTVSSAS

SEQ ID NO: 2566 - protein, 127 aa, Artificial Sequence
  Description of Artificial Sequence: Synthetic polypeptide
  VH3-23_IGHD2-2*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYFDYWGQGTLVTVSSAS

SEQ ID NO: 2567 - protein, 127 aa, Artificial Sequence
  Description of Artificial Sequence: Synthetic polypeptide
  VH3-23_IGHD2-2*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYFDYWGQGTLVTVSSAS

SEQ ID NO: 2568 - protein, 127 aa, Artificial Sequence
  Description of Artificial Sequence: Synthetic polypeptide
  VH3-23_IGHD2-8*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYFDYWGQGTLVTVSSAS

SEQ ID NO: 2569 - protein, 127 aa, Artificial Sequence
  Description of Artificial Sequence: Synthetic polypeptide
  VH3-23_IGHD2-8*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYFDYWGQGTLVTVSSAS

SEQ ID NO: 2570 - protein, 127 aa, Artificial Sequence
  Description of Artificial Sequence: Synthetic polypeptide
  VH3-23_IGHD2-15*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYFDYWGQGTLVTVSSAS

SEQ ID NO: 2571 - protein, 127 aa, Artificial Sequence
  Description of Artificial Sequence: Synthetic polypeptide
  VH3-23_IGHD2-15*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYFDYWGQGTLVTVSSAS

SEQ ID NO: 2572 - protein, 126 aa, Artificial Sequence
  Description of Artificial Sequence: Synthetic polypeptide
  VH3-23_IGHD2-21*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYFDYWGQGTLVTVSSAS

SEQ ID NO: 2573 - protein, 126 aa, Artificial Sequence
  Description of Artificial Sequence: Synthetic polypeptide
  VH3-23_IGHD2-21*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYFDYWGQGTLVTVSSAS

SEQ ID NO: 2574 - protein, 127 aa, Artificial Sequence
  Description of Artificial Sequence: Synthetic polypeptide
  VH3-23_IGHD3-3*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYFDYWGQGTLVTVSSAS

SEQ ID NO: 2575 - protein, 127 aa, Artificial Sequence
  Description of Artificial Sequence: Synthetic polypeptide
  VH3-23_IGHD3-3*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYFDYWGQGTLVTVSSAS

SEQ ID NO: 2576 - protein, 127 aa, Artificial Sequence
  Description of Artificial Sequence: Synthetic polypeptide
  VH3-23_IGHD3-3*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYFDYWGQGTLVTVSSAS

SEQ ID NO: 2577 - protein, 127 aa, Artificial Sequence
  Description of Artificial Sequence: Synthetic polypeptide
  VH3-23_IGHD3-9*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYFDYWGQGTLVTVSSAS

SEQ ID NO: 2578 - protein, 127 aa, Artificial Sequence
  Description of Artificial Sequence: Synthetic polypeptide
  VH3-23_IGHD3-10*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYFDYWGQGTLVTVSSAS

SEQ ID NO: 2579 - protein, 127 aa, Artificial Sequence
  Description of Artificial Sequence: Synthetic polypeptide
  VH3-23_IGHD3-10*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYYFDYWGQGTLVTVSSAS

SEQ ID NO: 2580 - protein, 129 aa, Artificial Sequence
  Description of Artificial Sequence: Synthetic polypeptide
  VH3-23_IGHD3-16*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYFDYWGQGTLVTVSSAS

SEQ ID NO: 2581 - protein, 129 aa, Artificial Sequence
  Description of Artificial Sequence: Synthetic polypeptide
  VH3-23_IGHD3-16*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYFDYWGQGTLVTVSSAS

SEQ ID NO: 2582 - protein, 127 aa, Artificial Sequence
  Description of Artificial Sequence: Synthetic polypeptide
  VH3-23_IGHD3-22*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYFDYWGQGTLVTVSSAS

SEQ ID NO: 2583 - protein, 127 aa, Artificial Sequence
  Description of Artificial Sequence: Synthetic polypeptide
  VH3-23_IGHD3-22*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYFDYWGQGTLVTVSSAS

SEQ ID NO: 2584 - protein, 122 aa, Artificial Sequence
  Description of Artificial Sequence: Synthetic polypeptide
  VH3-23_IGHD4-4*01(1)_1>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYFDYWGQGTLVTVSSAS

SEQ ID NO: 2585 - protein, 122 aa, Artificial Sequence
  Description of Artificial Sequence: Synthetic polypeptide
  VH3-23_IGHD4-4*01(1)_1>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYFDYWGQGTLVTVSSAS

SEQ ID NO: 2586 - protein, 122 aa, Artificial Sequence; identical to SEQ ID NO: 2584
  Description of Artificial Sequence: Synthetic polypeptide
  VH3-23_IGHD4-11*01(1)_1>2_IGHJ4*01

SEQ ID NO: 2587 - protein, 122 aa, Artificial Sequence; identical to SEQ ID NO: 2585
  Description of Artificial Sequence: Synthetic polypeptide
  VH3-23_IGHD4-11*01(1)_1>3_IGHJ4*01

SEQ ID NO: 2588 - protein, 122 aa, Artificial Sequence
  Description of Artificial Sequence: Synthetic polypeptide
  VH3-23_IGHD4-17*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYFDYWGQGTLVTVSSAS

SEQ ID NO: 2589 - protein, 122 aa, Artificial Sequence; identical to SEQ ID NO: 2585
  Description of Artificial Sequence: Synthetic polypeptide
  VH3-23_IGHD4-17*01>3_IGHJ4*01

SEQ ID NO: 2590 - protein, 123 aa, Artificial Sequence
  Description of Artificial Sequence: Synthetic polypeptide
  VH3-23_IGHD4-23*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYFDYWGQGTLVTVSSAS

SEQ ID NO: 2591 - protein, 123 aa, Artificial Sequence
  Description of Artificial Sequence: Synthetic polypeptide
  VH3-23_IGHD4-23*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYFDYWGQGTLVTVSSAS

SEQ ID NO: 2592 - protein, 124 aa, Artificial Sequence
  Description of Artificial Sequence: Synthetic polypeptide
  VH3-23_IGHD5-5*01(2)_1>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYFDYWGQGTLVTVSSAS

SEQ ID NO: 2593 - protein, 124 aa, Artificial Sequence
  Description of Artificial Sequence: Synthetic polypeptide
  VH3-23_IGHD5-5*01(2)_1>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYFDYWGQGTLVTVSSAS

SEQ ID NO: 2594 - protein, 124 aa, Artificial Sequence
  Description of Artificial Sequence: Synthetic polypeptide
  VH3-23_IGHD5-5*01(2)_1>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYFDYWGQGTLVTVSSAS

SEQ ID NO: 2595 - protein, 125 aa, Artificial Sequence
  Description of Artificial Sequence: Synthetic polypeptide
  VH3-23_IGHD5-12*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYFDYWGQGTLVTVSSAS

SEQ ID NO: 2596 - protein, 125 aa, Artificial Sequence
  Description of Artificial Sequence: Synthetic polypeptide
  VH3-23_IGHD5-12*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYFDYWGQGTLVTVSSAS

SEQ ID NO: 2597 - protein, 124 aa, Artificial Sequence; identical to SEQ ID NO: 2592
  Description of Artificial Sequence: Synthetic polypeptide
  VH3-23_IGHD5-18*01(2)_1>1_IGHJ4*01

SEQ ID NO: 2598 - protein, 124 aa, Artificial Sequence; identical to SEQ ID NO: 2593
  Description of Artificial Sequence: Synthetic polypeptide
  VH3-23_IGHD5-18*01(2)_1>2_IGHJ4*01

SEQ ID NO: 2599 - protein, 124 aa, Artificial Sequence; identical to SEQ ID NO: 2594
  Description of Artificial Sequence: Synthetic polypeptide
  VH3-23_IGHD5-18*01(2)_1>3_IGHJ4*01

SEQ ID NO: 2600 - protein, 124 aa, Artificial Sequence
  Description of Artificial Sequence: Synthetic polypeptide
  VH3-23_IGHD5-24*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYFDYWGQGTLVTVSSAS

SEQ ID NO: 2601 - protein, 124 aa, Artificial Sequence
  Description of Artificial Sequence: Synthetic polypeptide
  VH3-23_IGHD5-24*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYFDYWGQGTLVTVSSAS

SEQ ID NO: 2602 - protein, 123 aa, Artificial Sequence
  Description of Artificial Sequence: Synthetic polypeptide
  VH3-23_IGHD6-6*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYFDYWGQGTLVTVSSAS

SEQ ID NO: 2603 - protein, 123 aa, Artificial Sequence
  Description of Artificial Sequence: Synthetic polypeptide
  VH3-23_IGHD6-6*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYFDYWGQGTLVTVSSAS

SEQ ID NO: 2604 - protein, 124 aa, Artificial Sequence
  Description of Artificial Sequence: Synthetic polypeptide
  VH3-23_IGHD6-13*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYFDYWGQGTLVTVSSAS

SEQ ID NO: 2605 - protein, 124 aa, Artificial Sequence
  Description of Artificial Sequence: Synthetic polypeptide
  VH3-23_IGHD6-13*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYFDYWGQGTLVTVSSAS

SEQ ID NO: 2606 - protein, 124 aa, Artificial Sequence
  Description of Artificial Sequence: Synthetic polypeptide
  VH3-23_IGHD6-19*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYFDYWGQGTLVTVSSAS

SEQ ID NO: 2607 - protein, 124 aa, Artificial Sequence
  Description of Artificial Sequence: Synthetic polypeptide
  VH3-23_IGHD6-19*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYFDYWGQGTLVTVSSAS

SEQ ID NO: 2608 - protein, 123 aa, Artificial Sequence
  Description of Artificial Sequence: Synthetic polypeptide
  VH3-23_IGHD6-25*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYFDYWGQGTLVTVSSAS

SEQ ID NO: 2609 - protein, 123 aa, Artificial Sequence
  Description of Artificial Sequence: Synthetic polypeptide
  VH3-23_IGHD6-25*01>2_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYFDYWGQGTLVTVSSAS

SEQ ID NO: 2610 - protein, 121 aa, Artificial Sequence
  Description of Artificial Sequence: Synthetic polypeptide
  VH3-23_IGHD7-27*01>1_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYFDYWGQGTLVTVSSAS

SEQ ID NO: 2611 - protein, 121 aa, Artificial Sequence
  Description of Artificial Sequence: Synthetic polypeptide
  VH3-23_IGHD7-27*01>3_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYFDYWGQGTLVTVSSAS

SEQ ID NO: 2612 - protein, 123 aa, Artificial Sequence
  Description of Artificial Sequence: Synthetic polypeptide
  VH3-23_IGHD1-1*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYFDYWGQGTLVTVSSAS

SEQ ID NO: 2613 - protein, 123 aa, Artificial Sequence
  Description of Artificial Sequence: Synthetic polypeptide
  VH3-23_IGHD1-1*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYFDYWGQGTLVTVSSAS

SEQ ID NO: 2614 - protein, 123 aa, Artificial Sequence
  Description of Artificial Sequence: Synthetic polypeptide
  VH3-23_IGHD1-1*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYFDYWGQGTLVTVSSAS

SEQ ID NO: 2615 - protein, 123 aa, Artificial Sequence
  Description of Artificial Sequence: Synthetic polypeptide
  VH3-23_IGHD1-7*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYFDYWGQGTLVTVSSAS

SEQ ID NO: 2616 - protein, 123 aa, Artificial Sequence
  Description of Artificial Sequence: Synthetic polypeptide
  VH3-23_IGHD1-7*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYFDYWGQGTLVTVSSAS

SEQ ID NO: 2617 - protein, 123 aa, Artificial Sequence; identical to SEQ ID NO: 2615
  Description of Artificial Sequence: Synthetic polypeptide
  VH3-23_IGHD1-14*01>1'_IGHJ4*01

SEQ ID NO: 2618 - protein, 123 aa, Artificial Sequence
  Description of Artificial Sequence: Synthetic polypeptide
  VH3-23_IGHD1-14*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYFDYWGQGTLVTVSSAS

SEQ ID NO: 2619 - protein, 123 aa, Artificial Sequence
  Description of Artificial Sequence: Synthetic polypeptide
  VH3-23_IGHD1-14*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYFDYWGQGTLVTVSSAS

SEQ ID NO: 2620 - protein, 123 aa, Artificial Sequence; identical to SEQ ID NO: 2615
  Description of Artificial Sequence: Synthetic polypeptide
  VH3-23_IGHD1-20*01>1'_IGHJ4*01

SEQ ID NO: 2621 - protein, 123 aa, Artificial Sequence; identical to SEQ ID NO: 2613
  Description of Artificial Sequence: Synthetic polypeptide
  VH3-23_IGHD1-20*01>2'_IGHJ4*01

SEQ ID NO: 2622 - protein, 123 aa, Artificial Sequence
  Description of Artificial Sequence: Synthetic polypeptide
  VH3-23_IGHD1-20*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYFDYWGQGTLVTVSSAS

SEQ ID NO: 2623 - protein, 124 aa, Artificial Sequence
  Description of Artificial Sequence: Synthetic polypeptide
  VH3-23_IGHD1-26*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYFDYWGQGTLVTVSSAS

SEQ ID NO: 2624 - protein, 124 aa, Artificial Sequence
  Description of Artificial Sequence: Synthetic polypeptide
  VH3-23_IGHD1-26*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYFDYWGQGTLVTVSSAS

SEQ ID NO: 2625 - protein, 127 aa, Artificial Sequence
  Description of Artificial Sequence: Synthetic polypeptide
  VH3-23_IGHD2-2*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYFDYWGQGTLVTVSSAS

SEQ ID NO: 2626 - protein, 127 aa, Artificial Sequence
  Description of Artificial Sequence: Synthetic polypeptide
  VH3-23_IGHD2-2*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYFDYWGQGTLVTVSSAS

SEQ ID NO: 2627 - protein, 127 aa, Artificial Sequence
  Description of Artificial Sequence: Synthetic polypeptide
  VH3-23_IGHD2-8*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYFDYWGQGTLVTVSSAS

SEQ ID NO: 2628 - protein, 127 aa, Artificial Sequence
  Description of Artificial Sequence: Synthetic polypeptide
  VH3-23_IGHD2-15*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYFDYWGQGTLVTVSSAS

SEQ ID NO: 2629 - protein, 127 aa, Artificial Sequence
  Description of Artificial Sequence: Synthetic polypeptide
  VH3-23_IGHD2-15*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYFDYWGQGTLVTVSSAS

SEQ ID NO: 2630 - protein, 126 aa, Artificial Sequence
  Description of Artificial Sequence: Synthetic polypeptide
  VH3-23_IGHD2-21*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYFDYWGQGTLVTVSSAS

SEQ ID NO: 2631 - protein, 126 aa, Artificial Sequence
  Description of Artificial Sequence: Synthetic polypeptide
  VH3-23_IGHD2-21*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYFDYWGQGTLVTVSSAS

SEQ ID NO: 2632 - protein, 127 aa, Artificial Sequence
  Description of Artificial Sequence: Synthetic polypeptide
  VH3-23_IGHD3-3*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYFDYWGQGTLVTVSSAS

SEQ ID NO: 2633 - protein, 127 aa, Artificial Sequence
  Description of Artificial Sequence: Synthetic polypeptide
  VH3-23_IGHD3-3*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYFDYWGQGTLVTVSSAS

SEQ ID NO: 2634 - protein, 127 aa, Artificial Sequence
  Description of Artificial Sequence: Synthetic polypeptide
  VH3-23_IGHD3-9*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYFDYWGQGTLVTVSSAS

SEQ ID NO: 2635 - protein, 127 aa, Artificial Sequence
  Description of Artificial Sequence: Synthetic polypeptide
  VH3-23_IGHD3-9*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYFDYWGQGTLVTVSSAS

SEQ ID NO: 2636 - protein, 127 aa, Artificial Sequence
  Description of Artificial Sequence: Synthetic polypeptide
  VH3-23_IGHD3-10*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYFDYWGQGTLVTVSSAS

SEQ ID NO: 2637 - protein, 127 aa, Artificial Sequence
  Description of Artificial Sequence: Synthetic polypeptide
  VH3-23_IGHD3-10*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYFDYWGQGTLVTVSSAS

SEQ ID NO: 2638 - protein, 129 aa, Artificial Sequence
  Description of Artificial Sequence: Synthetic polypeptide
  VH3-23_IGHD3-16*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYFDYWGQGTLVTVSSAS

SEQ ID NO: 2639 - protein, 129 aa, Artificial Sequence
  Description of Artificial Sequence: Synthetic polypeptide
  VH3-23_IGHD3-16*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYFDYWGQGTLVTVSSAS

SEQ ID NO: 2640 - protein, 127 aa, Artificial Sequence
  Description of Artificial Sequence: Synthetic polypeptide
  VH3-23_IGHD3-22*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYFDYWGQGTLVTVSSAS

SEQ ID NO: 2641 - protein, 122 aa, Artificial Sequence
  Description of Artificial Sequence: Synthetic polypeptide
  VH3-23_IGHD4-4*01(1)_1>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYFDYWGQGTLVTVSSAS

SEQ ID NO: 2642 - protein, 122 aa, Artificial Sequence
  Description of Artificial Sequence: Synthetic polypeptide
  VH3-23_IGHD4-4*01(1)_1>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYFDYWGQGTLVTVSSAS

SEQ ID NO: 2643 - protein, 122 aa, Artificial Sequence; identical to SEQ ID NO: 2641
  Description of Artificial Sequence: Synthetic polypeptide
  VH3-23_IGHD4-11*01(1)_1>1'_IGHJ4*01

SEQ ID NO: 2644 - protein, 122 aa, Artificial Sequence; identical to SEQ ID NO: 2642
  Description of Artificial Sequence: Synthetic polypeptide
  VH3-23_IGHD4-11*01(1)_1>3'_IGHJ4*01

SEQ ID NO: 2645 - protein, 122 aa, Artificial Sequence; identical to SEQ ID NO: 2641
  Description of Artificial Sequence: Synthetic polypeptide
  VH3-23_IGHD4-17*01>1'_IGHJ4*01

SEQ ID NO: 2646 - protein, 122 aa, Artificial Sequence
  Description of Artificial Sequence: Synthetic polypeptide
  VH3-23_IGHD4-17*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYFDYWGQGTLVTVSSAS

SEQ ID NO: 2647 - protein, 123 aa, Artificial Sequence
  Description of Artificial Sequence: Synthetic polypeptide
  VH3-23_IGHD4-23*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYFDYWGQGTLVTVSSAS

SEQ ID NO: 2648 - protein, 123 aa, Artificial Sequence
  Description of Artificial Sequence: Synthetic polypeptide
  VH3-23_IGHD4-23*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYFDYWGQGTLVTVSSAS

SEQ ID NO: 2649 - protein, 124 aa, Artificial Sequence
  Description of Artificial Sequence: Synthetic polypeptide
  VH3-23_IGHD5-5*01(2)_1>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYFDYWGQGTLVTVSSAS

SEQ ID NO: 2650 - protein, 124 aa, Artificial Sequence
  Description of Artificial Sequence: Synthetic polypeptide
  VH3-23_IGHD5-5*01(2)_1>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYFDYWGQGTLVTVSSAS

SEQ ID NO: 2651 - protein, 125 aa, Artificial Sequence
  Description of Artificial Sequence: Synthetic polypeptide
  VH3-23_IGHD5-12*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYFDYWGQGTLVTVSSAS

SEQ ID NO: 2652 - protein, 125 aa, Artificial Sequence
  Description of Artificial Sequence: Synthetic polypeptide
  VH3-23_IGHD5-12*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYFDYWGQGTLVTVSSAS

SEQ ID NO: 2653 - protein, 124 aa, Artificial Sequence; identical to SEQ ID NO: 2649
  Description of Artificial Sequence: Synthetic polypeptide
  VH3-23_IGHD5-18*01(2)_1>1'_IGHJ4*01

SEQ ID NO: 2654 - protein, 124 aa, Artificial Sequence; identical to SEQ ID NO: 2650
  Description of Artificial Sequence: Synthetic polypeptide
  VH3-23_IGHD5-18*01(2)_1>3'_IGHJ4*01

SEQ ID NO: 2655 - protein, 124 aa, Artificial Sequence
  Description of Artificial Sequence: Synthetic polypeptide
  VH3-23_IGHD5-24*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYFDYWGQGTLVTVSSAS

SEQ ID NO: 2656 - protein, 124 aa, Artificial Sequence
  Description of Artificial Sequence: Synthetic polypeptide
  VH3-23_IGHD5-24*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYFDYWGQGTLVTVSSAS

SEQ ID NO: 2657 - protein, 123 aa, Artificial Sequence
  Description of Artificial Sequence: Synthetic polypeptide
  VH3-23_IGHD6-6*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYFDYWGQGTLVTVSSAS

SEQ ID NO: 2658 - protein, 123 aa, Artificial Sequence
  Description of Artificial Sequence: Synthetic polypeptide
  VH3-23_IGHD6-6*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYFDYWGQGTLVTVSSAS

SEQ ID NO: 2659 - protein, 123 aa, Artificial Sequence
  Description of Artificial Sequence: Synthetic polypeptide
  VH3-23_IGHD6-6*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYFDYWGQGTLVTVSSAS

SEQ ID NO: 2660 - protein, 124 aa, Artificial Sequence
  Description of Artificial Sequence: Synthetic polypeptide
  VH3-23_IGHD6-13*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYFDYWGQGTLVTVSSAS

SEQ ID NO: 2661 - protein, 124 aa, Artificial Sequence
  Description of Artificial Sequence: Synthetic polypeptide
  VH3-23_IGHD6-13*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYFDYWGQGTLVTVSSAS

SEQ ID NO: 2662 - protein, 124 aa, Artificial Sequence
  Description of Artificial Sequence: Synthetic polypeptide
  VH3-23_IGHD6-13*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYFDYWGQGTLVTVSSAS

SEQ ID NO: 2663 - protein, 124 aa, Artificial Sequence
  Description of Artificial Sequence: Synthetic polypeptide
  VH3-23_IGHD6-19*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYFDYWGQGTLVTVSSAS

SEQ ID NO: 2664 - protein, 124 aa, Artificial Sequence
  Description of Artificial Sequence: Synthetic polypeptide
  VH3-23_IGHD6-19*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYFDYWGQGTLVTVSSAS

SEQ ID NO: 2665 - protein, 124 aa, Artificial Sequence
  Description of Artificial Sequence: Synthetic polypeptide
  VH3-23_IGHD6-19*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYFDYWGQGTLVTVSSAS

SEQ ID NO: 2666 - protein, 123 aa, Artificial Sequence
  Description of Artificial Sequence: Synthetic polypeptide
  VH3-23_IGHD6-25*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYFDYWGQGTLVTVSSAS

SEQ ID NO: 2667 - protein, 123 aa, Artificial Sequence
  Description of Artificial Sequence: Synthetic polypeptide
  VH3-23_IGHD6-25*01>3'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYFDYWGQGTLVTVSSAS

SEQ ID NO: 2668 - protein, 121 aa, Artificial Sequence
  Description of Artificial Sequence: Synthetic polypeptide
  VH3-23_IGHD7-27*01>1'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYFDYWGQGTLVTVSSAS

SEQ ID NO: 2669 - protein, 121 aa, Artificial Sequence
  Description of Artificial Sequence: Synthetic polypeptide
  VH3-23_IGHD7-27*01>2'_IGHJ4*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYFDYWGQGTLVTVSSAS

SEQ ID NO: 2670 - protein, 124 aa, Artificial Sequence
  Description of Artificial Sequence: Synthetic polypeptide
  VH3-23_IGHD1-1*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYNWFDYWGQGTLVTVSSAS

SEQ ID NO: 2671 - protein, 124 aa, Artificial Sequence
  Description of Artificial Sequence: Synthetic polypeptide
  VH3-23_IGHD1-1*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYNWFDYWGQGTLVTVSSAS

SEQ ID NO: 2672 - protein, 124 aa, Artificial Sequence
  Description of Artificial Sequence: Synthetic polypeptide
  VH3-23_IGHD1-1*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYNWFDYWGQGTLVTVSSAS

SEQ ID NO: 2673 - protein, 124 aa, Artificial Sequence
  Description of Artificial Sequence: Synthetic polypeptide
  VH3-23_IGHD1-7*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYNWFDYWGQGTLVTVSSAS

SEQ ID NO: 2674 - protein, 124 aa, Artificial Sequence
  Description of Artificial Sequence: Synthetic polypeptide
  VH3-23_IGHD1-7*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYNWFDYWGQGTLVTVSSAS

SEQ ID NO: 2675 - protein, 124 aa, Artificial Sequence; identical to SEQ ID NO: 2673
  Description of Artificial Sequence: Synthetic polypeptide
  VH3-23_IGHD1-14*01>1_IGHJ5*01

SEQ ID NO: 2676 - protein, 124 aa, Artificial Sequence
  Description of Artificial Sequence: Synthetic polypeptide
  VH3-23_IGHD1-14*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYNWFDYWGQGTLVTVSSAS

SEQ ID NO: 2677 - protein, 124 aa, Artificial Sequence; identical to SEQ ID NO: 2673
  Description of Artificial Sequence: Synthetic polypeptide
  VH3-23_IGHD1-20*01>1_IGHJ5*01

SEQ ID NO: 2678 - protein, 124 aa, Artificial Sequence; identical to SEQ ID NO: 2672
  Description of Artificial Sequence: Synthetic polypeptide
  VH3-23_IGHD1-20*01>3_IGHJ5*01

SEQ ID NO: 2679 - protein, 125 aa, Artificial Sequence
  Description of Artificial Sequence: Synthetic polypeptide
  VH3-23_IGHD1-26*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYNWFDYWGQGTLVTVSSAS

SEQ ID NO: 2680 - protein, 125 aa, Artificial Sequence
  Description of Artificial Sequence: Synthetic polypeptide
  VH3-23_IGHD1-26*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYNWFDYWGQGTLVTVSSAS

SEQ ID NO: 2681 - protein, 128 aa, Artificial Sequence
  Description of Artificial Sequence: Synthetic polypeptide
  VH3-23_IGHD2-2*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYNWFDYWGQGTLVTVSSAS

SEQ ID NO: 2682 - protein, 128 aa, Artificial Sequence
  Description of Artificial Sequence: Synthetic polypeptide
  VH3-23_IGHD2-2*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYNWFDYWGQGTLVTVSSAS

SEQ ID NO: 2683 - protein, 128 aa, Artificial Sequence
  Description of Artificial Sequence: Synthetic polypeptide
  VH3-23_IGHD2-8*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYNWFDYWGQGTLVTVSSAS

SEQ ID NO: 2684 - protein, 128 aa, Artificial Sequence
  Description of Artificial Sequence: Synthetic polypeptide
  VH3-23_IGHD2-8*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYNWFDYWGQGTLVTVSSAS

SEQ ID NO: 2685 - protein, 128 aa, Artificial Sequence
  Description of Artificial Sequence: Synthetic polypeptide
  VH3-23_IGHD2-15*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYNWFDYWGQGTLVTVSSAS

SEQ ID NO: 2686 - protein, 128 aa, Artificial Sequence
  Description of Artificial Sequence: Synthetic polypeptide
  VH3-23_IGHD2-15*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYNWFDYWGQGTLVTVSSAS

SEQ ID NO: 2687 - protein, 127 aa, Artificial Sequence
  Description of Artificial Sequence: Synthetic polypeptide
  VH3-23_IGHD2-21*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYNWFDYWGQGTLVTVSSAS

SEQ ID NO: 2688 - protein, 127 aa, Artificial Sequence
  Description of Artificial Sequence: Synthetic polypeptide
  VH3-23_IGHD2-21*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYNWFDYWGQGTLVTVSSAS

SEQ ID NO: 2689 - protein, 128 aa, Artificial Sequence
  Description of Artificial Sequence: Synthetic polypeptide
  VH3-23_IGHD3-3*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYNWFDYWGQGTLVTVSSAS

SEQ ID NO: 2690 - protein, 128 aa, Artificial Sequence
  Description of Artificial Sequence: Synthetic polypeptide
  VH3-23_IGHD3-3*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYNWFDYWGQGTLVTVSSAS

SEQ ID NO: 2691 - protein, 128 aa, Artificial Sequence
  Description of Artificial Sequence: Synthetic polypeptide
  VH3-23_IGHD3-3*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYNWFDYWGQGTLVTVSSAS

SEQ ID NO: 2692 - protein, 128 aa, Artificial Sequence
  Description of Artificial Sequence: Synthetic polypeptide
  VH3-23_IGHD3-9*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYNWFDYWGQGTLVTVSSAS

SEQ ID NO: 2693 - protein, 128 aa, Artificial Sequence
  Description of Artificial Sequence: Synthetic polypeptide
  VH3-23_IGHD3-10*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYNWFDYWGQGTLVTVSSAS

SEQ ID NO: 2694 - protein, 128 aa, Artificial Sequence
  Description of Artificial Sequence: Synthetic polypeptide
  VH3-23_IGHD3-10*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMVRGVIISYNWFDYWGQGTLVTVSSAS

SEQ ID NO: 2695 - protein, 130 aa, Artificial Sequence
  Description of Artificial Sequence: Synthetic polypeptide
  VH3-23_IGHD3-16*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYNWFDYWGQGTLVTVSSAS

SEQ ID NO: 2696 - protein, 130 aa, Artificial Sequence
  Description of Artificial Sequence: Synthetic polypeptide
  VH3-23_IGHD3-16*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYNWFDYWGQGTLVTVSSAS

SEQ ID NO: 2697 - protein, 128 aa, Artificial Sequence
  Description of Artificial Sequence: Synthetic polypeptide
  VH3-23_IGHD3-22*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYNWFDYWGQGTLVTVSSAS

SEQ ID NO: 2698 - protein, 128 aa, Artificial Sequence
  Description of Artificial Sequence: Synthetic polypeptide
  VH3-23_IGHD3-22*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYNWFDYWGQGTLVTVSSAS

SEQ ID NO: 2699 - protein, 123 aa, Artificial Sequence
  Description of Artificial Sequence: Synthetic polypeptide
  VH3-23_IGHD4-4*01(1)_1>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYNWFDYWGQGTLVTVSSAS

SEQ ID NO: 2700 - protein, 123 aa, Artificial Sequence
  Description of Artificial Sequence: Synthetic polypeptide
  VH3-23_IGHD4-4*01(1)_1>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYNWFDYWGQGTLVTVSSAS

SEQ ID NO: 2701 - protein, 123 aa, Artificial Sequence; identical to SEQ ID NO: 2699
  Description of Artificial Sequence: Synthetic polypeptide
  VH3-23_IGHD4-11*01(1)_1>2_IGHJ5*01

SEQ ID NO: 2702 - protein, 123 aa, Artificial Sequence; identical to SEQ ID NO: 2700
  Description of Artificial Sequence: Synthetic polypeptide
  VH3-23_IGHD4-11*01(1)_1>3_IGHJ5*01

SEQ ID NO: 2703 - protein, 123 aa, Artificial Sequence
  Description of Artificial Sequence: Synthetic polypeptide
  VH3-23_IGHD4-17*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYNWFDYWGQGTLVTVSSAS

SEQ ID NO: 2704 - protein, 123 aa, Artificial Sequence; identical to SEQ ID NO: 2700
  Description of Artificial Sequence: Synthetic polypeptide
  VH3-23_IGHD4-17*01>3_IGHJ5*01

SEQ ID NO: 2705 - protein, 124 aa, Artificial Sequence
  Description of Artificial Sequence: Synthetic polypeptide
  VH3-23_IGHD4-23*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYNWFDYWGQGTLVTVSSAS

SEQ ID NO: 2706 - protein, 124 aa, Artificial Sequence
  Description of Artificial Sequence: Synthetic polypeptide
  VH3-23_IGHD4-23*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYNWFDYWGQGTLVTVSSAS

SEQ ID NO: 2707 - protein, 125 aa, Artificial Sequence
  Description of Artificial Sequence: Synthetic polypeptide
  VH3-23_IGHD5-5*01(2)_1>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYNWFDYWGQGTLVTVSSAS

SEQ ID NO: 2708 - protein, 125 aa, Artificial Sequence
  Description of Artificial Sequence: Synthetic polypeptide
  VH3-23_IGHD5-5*01(2)_1>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYNWFDYWGQGTLVTVSSAS

SEQ ID NO: 2709 - protein, 125 aa, Artificial Sequence
  Description of Artificial Sequence: Synthetic polypeptide
  VH3-23_IGHD5-5*01(2)_1>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYNWFDYWGQGTLVTVSSAS

SEQ ID NO: 2710 - protein, 126 aa, Artificial Sequence
  Description of Artificial Sequence: Synthetic polypeptide
  VH3-23_IGHD5-12*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYNWFDYWGQGTLVTVSSAS

SEQ ID NO: 2711 - protein, 126 aa, Artificial Sequence
  Description of Artificial Sequence: Synthetic polypeptide
  VH3-23_IGHD5-12*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYNWFDYWGQGTLVTVSSAS

SEQ ID NO: 2712 - protein, 125 aa, Artificial Sequence; identical to SEQ ID NO: 2707
  Description of Artificial Sequence: Synthetic polypeptide
  VH3-23_IGHD5-18*01(2)_1>1_IGHJ5*01

SEQ ID NO: 2713 - protein, 125 aa, Artificial Sequence; identical to SEQ ID NO: 2708
  Description of Artificial Sequence: Synthetic polypeptide
  VH3-23_IGHD5-18*01(2)_1>2_IGHJ5*01

SEQ ID NO: 2714 - protein, 125 aa, Artificial Sequence; identical to SEQ ID NO: 2709
  Description of Artificial Sequence: Synthetic polypeptide
  VH3-23_IGHD5-18*01(2)_1>3_IGHJ5*01

SEQ ID NO: 2715 - protein, 125 aa, Artificial Sequence
  Description of Artificial Sequence: Synthetic polypeptide
  VH3-23_IGHD5-24*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYNWFDYWGQGTLVTVSSAS

SEQ ID NO: 2716 - protein, 125 aa, Artificial Sequence
  Description of Artificial Sequence: Synthetic polypeptide
  VH3-23_IGHD5-24*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYNWFDYWGQGTLVTVSSAS

SEQ ID NO: 2717 - protein, 124 aa, Artificial Sequence
  Description of Artificial Sequence: Synthetic polypeptide
  VH3-23_IGHD6-6*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYNWFDYWGQGTLVTVSSAS

SEQ ID NO: 2718 - protein, 124 aa, Artificial Sequence
  Description of Artificial Sequence: Synthetic polypeptide
  VH3-23_IGHD6-6*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYNWFDYWGQGTLVTVSSAS

SEQ ID NO: 2719 - protein, 125 aa, Artificial Sequence
  Description of Artificial Sequence: Synthetic polypeptide
  VH3-23_IGHD6-13*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYNWFDYWGQGTLVTVSSAS

SEQ ID NO: 2720 - protein, 125 aa, Artificial Sequence
  Description of Artificial Sequence: Synthetic polypeptide
  VH3-23_IGHD6-13*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYNWFDYWGQGTLVTVSSAS

SEQ ID NO: 2721 - protein, 125 aa, Artificial Sequence
  Description of Artificial Sequence: Synthetic polypeptide
  VH3-23_IGHD6-19*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYNWFDYWGQGTLVTVSSAS

SEQ ID NO: 2722 - protein, 125 aa, Artificial Sequence
  Description of Artificial Sequence: Synthetic polypeptide
  VH3-23_IGHD6-19*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYNWFDYWGQGTLVTVSSAS

SEQ ID NO: 2723 - protein, 124 aa, Artificial Sequence
  Description of Artificial Sequence: Synthetic polypeptide
  VH3-23_IGHD6-25*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYNWFDYWGQGTLVTVSSAS

SEQ ID NO: 2724 - protein, 124 aa, Artificial Sequence
  Description of Artificial Sequence: Synthetic polypeptide
  VH3-23_IGHD6-25*01>2_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYNWFDYWGQGTLVTVSSAS

SEQ ID NO: 2725 - protein, 122 aa, Artificial Sequence
  Description of Artificial Sequence: Synthetic polypeptide
  VH3-23_IGHD7-27*01>1_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYNWFDYWGQGTLVTVSSAS

SEQ ID NO: 2726 - protein, 122 aa, Artificial Sequence
  Description of Artificial Sequence: Synthetic polypeptide
  VH3-23_IGHD7-27*01>3_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYNWFDYWGQGTLVTVSSAS

SEQ ID NO: 2727 - protein, 124 aa, Artificial Sequence
  Description of Artificial Sequence: Synthetic polypeptide
  VH3-23_IGHD1-1*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYNWFDYWGQGTLVTVSSAS

SEQ ID NO: 2728 - protein, 124 aa, Artificial Sequence
  Description of Artificial Sequence: Synthetic polypeptide
  VH3-23_IGHD1-1*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYNWFDYWGQGTLVTVSSAS

SEQ ID NO: 2729 - protein, 124 aa, Artificial Sequence
  Description of Artificial Sequence: Synthetic polypeptide
  VH3-23_IGHD1-1*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYNWFDYWGQGTLVTVSSAS

SEQ ID NO: 2730 - protein, 124 aa, Artificial Sequence
  Description of Artificial Sequence: Synthetic polypeptide
  VH3-23_IGHD1-7*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYNWFDYWGQGTLVTVSSAS

SEQ ID NO: 2731 - protein, 124 aa, Artificial Sequence
  Description of Artificial Sequence: Synthetic polypeptide
  VH3-23_IGHD1-7*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYNWFDYWGQGTLVTVSSAS

SEQ ID NO: 2732 - protein, 124 aa, Artificial Sequence; identical to SEQ ID NO: 2730
  Description of Artificial Sequence: Synthetic polypeptide
  VH3-23_IGHD1-14*01>1'_IGHJ5*01

SEQ ID NO: 2733 - protein, 124 aa, Artificial Sequence
  Description of Artificial Sequence: Synthetic polypeptide
  VH3-23_IGHD1-14*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYNWFDYWGQGTLVTVSSAS

SEQ ID NO: 2734 - protein, 124 aa, Artificial Sequence
  Description of Artificial Sequence: Synthetic polypeptide
  VH3-23_IGHD1-14*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYNWFDYWGQGTLVTVSSAS

SEQ ID NO: 2735 - protein, 124 aa, Artificial Sequence; identical to SEQ ID NO: 2730
  Description of Artificial Sequence: Synthetic polypeptide
  VH3-23_IGHD1-20*01>1'_IGHJ5*01

SEQ ID NO: 2736 - protein, 124 aa, Artificial Sequence; identical to SEQ ID NO: 2728
  Description of Artificial Sequence: Synthetic polypeptide
  VH3-23_IGHD1-20*01>2'_IGHJ5*01

SEQ ID NO: 2737 - protein, 124 aa, Artificial Sequence
  Description of Artificial Sequence: Synthetic polypeptide
  VH3-23_IGHD1-20*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYNWFDYWGQGTLVTVSSAS

SEQ ID NO: 2738 - protein, 125 aa, Artificial Sequence
  Description of Artificial Sequence: Synthetic polypeptide
  VH3-23_IGHD1-26*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYNWFDYWGQGTLVTVSSAS

SEQ ID NO: 2739 - protein, 125 aa, Artificial Sequence
  Description of Artificial Sequence: Synthetic polypeptide
  VH3-23_IGHD1-26*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYNWFDYWGQGTLVTVSSAS

SEQ ID NO: 2740 - protein, 128 aa, Artificial Sequence
  Description of Artificial Sequence: Synthetic polypeptide
  VH3-23_IGHD2-2*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYNWFDYWGQGTLVTVSSAS

SEQ ID NO: 2741 - protein, 128 aa, Artificial Sequence
  Description of Artificial Sequence: Synthetic polypeptide
  VH3-23_IGHD2-2*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYNWFDYWGQGTLVTVSSAS

SEQ ID NO: 2742 - protein, 128 aa, Artificial Sequence
  Description of Artificial Sequence: Synthetic polypeptide
  VH3-23_IGHD2-8*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYNWFDYWGQGTLVTVSSAS

SEQ ID NO: 2743 - protein, 128 aa, Artificial Sequence
  Description of Artificial Sequence: Synthetic polypeptide
  VH3-23_IGHD2-15*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYNWFDYWGQGTLVTVSSAS

SEQ ID NO: 2744 - protein, 128 aa, Artificial Sequence
  Description of Artificial Sequence: Synthetic polypeptide
  VH3-23_IGHD2-15*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYNWFDYWGQGTLVTVSSAS

SEQ ID NO: 2745 - protein, 127 aa, Artificial Sequence
  Description of Artificial Sequence: Synthetic polypeptide
  VH3-23_IGHD2-21*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYNWFDYWGQGTLVTVSSAS

SEQ ID NO: 2746 - protein, 127 aa, Artificial Sequence
  Description of Artificial Sequence: Synthetic polypeptide
  VH3-23_IGHD2-21*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYNWFDYWGQGTLVTVSSAS

SEQ ID NO: 2747 - protein, 128 aa, Artificial Sequence
  Description of Artificial Sequence: Synthetic polypeptide
  VH3-23_IGHD3-3*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYNWFDYWGQGTLVTVSSAS

SEQ ID NO: 2748 - protein, 128 aa, Artificial Sequence
  Description of Artificial Sequence: Synthetic polypeptide
  VH3-23_IGHD3-3*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYNWFDYWGQGTLVTVSSAS

SEQ ID NO: 2749 - protein, 128 aa, Artificial Sequence
  Description of Artificial Sequence: Synthetic polypeptide
  VH3-23_IGHD3-9*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYNWFDYWGQGTLVTVSSAS

SEQ ID NO: 2750 - protein, 128 aa, Artificial Sequence
  Description of Artificial Sequence: Synthetic polypeptide
  VH3-23_IGHD3-9*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYNWFDYWGQGTLVTVSSAS

SEQ ID NO: 2751 - protein, 128 aa, Artificial Sequence
  Description of Artificial Sequence: Synthetic polypeptide
  VH3-23_IGHD3-10*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYNWFDYWGQGTLVTVSSAS

SEQ ID NO: 2752 - protein, 128 aa, Artificial Sequence
  Description of Artificial Sequence: Synthetic polypeptide
  VH3-23_IGHD3-10*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYNWFDYWGQGTLVTVSSAS

SEQ ID NO: 2753 - protein, 130 aa, Artificial Sequence
  Description of Artificial Sequence: Synthetic polypeptide
  VH3-23_IGHD3-16*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYNWFDYWGQGTLVTVSSAS

SEQ ID NO: 2754 - protein, 130 aa, Artificial Sequence
  Description of Artificial Sequence: Synthetic polypeptide
  VH3-23_IGHD3-16*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYNWFDYWGQGTLVTVSSAS

SEQ ID NO: 2755 - protein, 128 aa, Artificial Sequence
  Description of Artificial Sequence: Synthetic polypeptide
  VH3-23_IGHD3-22*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYNWFDYWGQGTLVTVSSAS

SEQ ID NO: 2756 - protein, 123 aa, Artificial Sequence
  Description of Artificial Sequence: Synthetic polypeptide
  VH3-23_IGHD4-4*01(1)_1>1'_IGHJ5*
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYNWFDYWGQGTLVTVSSAS

SEQ ID NO: 2757 - protein, 123 aa, Artificial Sequence
  Description of Artificial Sequence: Synthetic polypeptide
  VH3-23_IGHD4-4*01(1)_1>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYNWFDYWGQGTLVTVSSAS

SEQ ID NO: 2758 - protein, 123 aa, Artificial Sequence; identical to SEQ ID NO: 2756
  Description of Artificial Sequence: Synthetic polypeptide
  VH3-23_IGHD4-11*01(1)_1>1'_IGHJ5*01

SEQ ID NO: 2759 - protein, 123 aa, Artificial Sequence; identical to SEQ ID NO: 2757
  Description of Artificial Sequence: Synthetic polypeptide
  VH3-23_IGHD4-11*01(1)_1>3'_IGHJ5*01

SEQ ID NO: 2760 - protein, 123 aa, Artificial Sequence; identical to SEQ ID NO: 2756
  Description of Artificial Sequence: Synthetic polypeptide
  VH3-23_IGHD4-17*01>1'_IGHJ5*01

SEQ ID NO: 2761 - protein, 123 aa, Artificial Sequence
  Description of Artificial Sequence: Synthetic polypeptide
  VH3-23_IGHD4-17*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYNWFDYWGQGTLVTVSSAS

SEQ ID NO: 2762 - protein, 124 aa, Artificial Sequence
  Description of Artificial Sequence: Synthetic polypeptide
  VH3-23_IGHD4-23*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYNWFDYWGQGTLVTVSSAS

SEQ ID NO: 2763 - protein, 124 aa, Artificial Sequence
  Description of Artificial Sequence: Synthetic polypeptide
  VH3-23_IGHD4-23*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYNWFDYWGQGTLVTVSSAS

SEQ ID NO: 2764 - protein, 125 aa, Artificial Sequence
  Description of Artificial Sequence: Synthetic polypeptide
  VH3-23_IGHD5-5*01(2)_1>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYNWFDYWGQGTLVTVSSAS

SEQ ID NO: 2765 - protein, 125 aa, Artificial Sequence
  Description of Artificial Sequence: Synthetic polypeptide
  VH3-23_IGHD5-5*01(2)_1>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYNWFDYWGQGTLVTVSSAS

SEQ ID NO: 2766 - protein, 126 aa, Artificial Sequence
  Description of Artificial Sequence: Synthetic polypeptide
  VH3-23_IGHD5-12*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYNWFDYWGQGTLVTVSSAS

SEQ ID NO: 2767 - protein, 126 aa, Artificial Sequence
  Description of Artificial Sequence: Synthetic polypeptide
  VH3-23_IGHD5-12*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYNWFDYWGQGTLVTVSSAS

SEQ ID NO: 2768 - protein, 125 aa, Artificial Sequence; identical to SEQ ID NO: 2764
  Description of Artificial Sequence: Synthetic polypeptide
  VH3-23_IGHD5-18*01(2)_1>1'_IGHJ5*01

SEQ ID NO: 2769 - protein, 125 aa, Artificial Sequence; identical to SEQ ID NO: 2765
  Description of Artificial Sequence: Synthetic polypeptide
  VH3-23_IGHD5-18*01(2)_1>3'_IGHJ5*01

SEQ ID NO: 2770 - protein, 125 aa, Artificial Sequence
  Description of Artificial Sequence: Synthetic polypeptide
  VH3-23_IGHD5-24*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYNWFDYWGQGTLVTVSSAS

SEQ ID NO: 2771 - protein, 125 aa, Artificial Sequence
  Description of Artificial Sequence: Synthetic polypeptide
  VH3-23_IGHD5-24*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYNWFDYWGQGTLVTVSSAS

SEQ ID NO: 2772 - protein, 124 aa, Artificial Sequence
  Description of Artificial Sequence: Synthetic polypeptide
  VH3-23_IGHD6-6*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYNWFDYWGQGTLVTVSSAS

SEQ ID NO: 2773 - protein, 124 aa, Artificial Sequence
  Description of Artificial Sequence: Synthetic polypeptide
  VH3-23_IGHD6-6*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYNWFDYWGQGTLVTVSSAS

SEQ ID NO: 2774 - protein, 124 aa, Artificial Sequence
  Description of Artificial Sequence: Synthetic polypeptide
  VH3-23_IGHD6-6*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYNWFDYWGQGTLVTVSSAS

SEQ ID NO: 2775 - protein, 125 aa, Artificial Sequence
  Description of Artificial Sequence: Synthetic polypeptide
  VH3-23_IGHD6-13*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYNWFDYWGQGTLVTVSSAS

SEQ ID NO: 2776 - protein, 125 aa, Artificial Sequence
  Description of Artificial Sequence: Synthetic polypeptide
  VH3-23_IGHD6-13*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYNWFDYWGQGTLVTVSSAS

SEQ ID NO: 2777 - protein, 125 aa, Artificial Sequence
  Description of Artificial Sequence: Synthetic polypeptide
  VH3-23_IGHD6-13*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYNWFDYWGQGTLVTVSSAS

SEQ ID NO: 2778 - protein, 125 aa, Artificial Sequence
  Description of Artificial Sequence: Synthetic polypeptide
  VH3-23_IGHD6-19*01>1'_IGHJ5*0
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYNWFDYWGQGTLVTVSSAS

SEQ ID NO: 2779 - protein, 125 aa, Artificial Sequence
  Description of Artificial Sequence: Synthetic polypeptide
  VH3-23_IGHD6-19*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYNWFDYWGQGTLVTVSSAS

SEQ ID NO: 2780 - protein, 125 aa, Artificial Sequence
  Description of Artificial Sequence: Synthetic polypeptide
  VH3-23_IGHD6-19*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYNWFDYWGQGTLVTVSSAS

SEQ ID NO: 2781 - protein, 124 aa, Artificial Sequence
  Description of Artificial Sequence: Synthetic polypeptide
  VH3-23_IGHD6-25*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYNWFDYWGQGTLVTVSSAS

SEQ ID NO: 2782 - protein, 124 aa, Artificial Sequence
  Description of Artificial Sequence: Synthetic polypeptide
  VH3-23_IGHD6-25*01>3'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYNWFDYWGQGTLVTVSSAS

SEQ ID NO: 2783 - protein, 122 aa, Artificial Sequence
  Description of Artificial Sequence: Synthetic polypeptide
  VH3-23_IGHD7-27*01>1'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYNWFDYWGQGTLVTVSSAS

SEQ ID NO: 2784 - protein, 122 aa, Artificial Sequence
  Description of Artificial Sequence: Synthetic polypeptide
  VH3-23_IGHD7-27*01>2'_IGHJ5*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYNWFDYWGQGTLVTVSSAS

SEQ ID NO: 2785 - protein, 128 aa, Artificial Sequence
  Description of Artificial Sequence: Synthetic polypeptide
  VH3-23_IGHD1-1*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTTGTTSYYYYYYGMDVWGQGTLVTVSSAS

SEQ ID NO: 2786 - protein, 128 aa, Artificial Sequence
  Description of Artificial Sequence: Synthetic polypeptide
  VH3-23_IGHD1-1*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVQLERRSYYYYYYGMDVWGQGTLVTVSSAS

SEQ ID NO: 2787 - protein, 128 aa, Artificial Sequence
  Description of Artificial Sequence: Synthetic polypeptide
  VH3-23_IGHD1-1*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNDSYYYYYYGMDVWGQGTLVTVSSAS

SEQ ID NO: 2788 - protein, 128 aa, Artificial Sequence
  Description of Artificial Sequence: Synthetic polypeptide
  VH3-23_IGHD1-7*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITGTTSYYYYYYGMDVWGQGTLVTVSSAS

SEQ ID NO: 2789 - protein, 128 aa, Artificial Sequence
  Description of Artificial Sequence: Synthetic polypeptide
  VH3-23_IGHD1-7*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNWNYSYYYYYYGMDVWGQGTLVTVSSAS

SEQ ID NO: 2790 - protein, 128 aa, Artificial Sequence; identical to SEQ ID NO: 2788
  Description of Artificial Sequence: Synthetic polypeptide
  VH3-23_IGHD1-14*01>1_IGHJ6*01

SEQ ID NO: 2791 - protein, 128 aa, Artificial Sequence
  Description of Artificial Sequence: Synthetic polypeptide
  VH3-23_IGHD1-14*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNRNHSYYYYYYGMDVWGQGTLVTVSSAS

SEQ ID NO: 2792 - protein, 128 aa, Artificial Sequence; identical to SEQ ID NO: 2788
  Description of Artificial Sequence: Synthetic polypeptide
  VH3-23_IGHD1-20*01>1_IGHJ6*01

SEQ ID NO: 2793 - protein, 128 aa, Artificial Sequence; identical to SEQ ID NO: 2787
  Description of Artificial Sequence: Synthetic polypeptide
  VH3-23_IGHD1-20*01>3_IGHJ6*01

SEQ ID NO: 2794 - protein, 129 aa, Artificial Sequence
  Description of Artificial Sequence: Synthetic polypeptide
  VH3-23_IGHD1-26*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIVGATTSYYYYYYGMDVWGQGTLVTVSSAS

SEQ ID NO: 2795 - protein, 129 aa, Artificial Sequence
  Description of Artificial Sequence: Synthetic polypeptide
  VH3-23_IGHD1-26*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSGSYYSYYYYYYGMDVWGQGTLVTVSSAS

SEQ ID NO: 2796 - protein, 132 aa, Artificial Sequence
  Description of Artificial Sequence: Synthetic polypeptide
  VH3-23_IGHD2-2*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSSTSCYASYYYYYYGMDVWGQGTLVTVSSAS

SEQ ID NO: 2797 - protein, 132 aa, Artificial Sequence
  Description of Artificial Sequence: Synthetic polypeptide
  VH3-23_IGHD2-2*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVPAAMSYYYYYYGMDVWGQGTLVTVSSAS

SEQ ID NO: 2798 - protein, 132 aa, Artificial Sequence
  Description of Artificial Sequence: Synthetic polypeptide
  VH3-23_IGHD2-8*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCTNGVCYTSYYYYYYGMDVWGQGTLVTVSSAS

SEQ ID NO: 2799 - protein, 132 aa, Artificial Sequence
  Description of Artificial Sequence: Synthetic polypeptide
  VH3-23_IGHD2-8*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVLMVYAISYYYYYYGMDVWGQGTLVTVSSAS

SEQ ID NO: 2800 - protein, 132 aa, Artificial Sequence
  Description of Artificial Sequence: Synthetic polypeptide
  VH3-23_IGHD2-15*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYCSGGSCYSSYYYYYYGMDVWGQGTLVTVSSAS

SEQ ID NO: 2801 - protein, 132 aa, Artificial Sequence
  Description of Artificial Sequence: Synthetic polypeptide
  VH3-23_IGHD2-15*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEDIVVVVAATSYYYYYYGMDVWGQGTLVTVSSAS

SEQ ID NO: 2802 - protein, 131 aa, Artificial Sequence
  Description of Artificial Sequence: Synthetic polypeptide
  VH3-23_IGHD2-21*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKAYCGGDCYSSYYYYYYGMDVWGQGTLVTVSSAS

SEQ ID NO: 2803 - protein, 131 aa, Artificial Sequence
  Description of Artificial Sequence: Synthetic polypeptide
  VH3-23_IGHD2-21*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEHIVVVIAISYYYYYYGMDVWGQGTLVTVSSAS

SEQ ID NO: 2804 - protein, 132 aa, Artificial Sequence
  Description of Artificial Sequence: Synthetic polypeptide
  VH3-23_IGHD3-3*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVLRFLEWLLYSYYYYYYGMDVWGQGTLVTVSSAS

SEQ ID NO: 2805 - protein, 132 aa, Artificial Sequence
  Description of Artificial Sequence: Synthetic polypeptide
  VH3-23_IGHD3-3*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDFWSGYYTSYYYYYYGMDVWGQGTLVTVSSAS

SEQ ID NO: 2806 - protein, 132 aa, Artificial Sequence
  Description of Artificial Sequence: Synthetic polypeptide
  VH3-23_IGHD3-3*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITIFGVVIISYYYYYYGMDVWGQGTLVTVSSAS

SEQ ID NO: 2807 - protein, 132 aa, Artificial Sequence
  Description of Artificial Sequence: Synthetic polypeptide
  VH3-23_IGHD3-9*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDILTGYYNSYYYYYYGMDVWGQGTLVTVSSAS

SEQ ID NO: 2808 - protein, 132 aa, Artificial Sequence
  Description of Artificial Sequence: Synthetic polypeptide
  VH3-23_IGHD3-10*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYGSGSYYNSYYYYYYGMDVWGQGTLVTVSSAS

SEQ ID NO: 2809 - protein, 134 aa, Artificial Sequence
  Description of Artificial Sequence: Synthetic polypeptide
  VH3-23_IGHD3-16*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYDYVWGSYAYTSYYYYYYGMDVWGQGTLVTVSSAS

SEQ ID NO: 2810 - protein, 134 aa, Artificial Sequence
  Description of Artificial Sequence: Synthetic polypeptide
  VH3-23_IGHD3-16*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIMITFGGVMLISYYYYYYGMDVWGQGTLVTVSSAS

SEQ ID NO: 2811 - protein, 132 aa, Artificial Sequence
  Description of Artificial Sequence: Synthetic polypeptide
  VH3-23_IGHD3-22*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYYYDSSGYYYSYYYYYYGMDVWGQGTLVTVSSAS

SEQ ID NO: 2812 - protein, 132 aa, Artificial Sequence
  Description of Artificial Sequence: Synthetic polypeptide
  VH3-23_IGHD3-22*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGITMIVVVITSYYYYYYGMDVWGQGTLVTVSSAS

SEQ ID NO: 2813 - protein, 127 aa, Artificial Sequence
  Description of Artificial Sequence: Synthetic polypeptide
  VH3-23_IGHD4-4*01(1)_1>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYSNYSYYYYYYGMDVWGQGTLVTVSSAS

SEQ ID NO: 2814 - protein, 127 aa, Artificial Sequence
  Description of Artificial Sequence: Synthetic polypeptide
  VH3-23_IGHD4-4*01(1)_1>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVTSYYYYYYGMDVWGQGTLVTVSSAS

SEQ ID NO: 2815 - protein, 127 aa, Artificial Sequence; identical to SEQ ID NO: 2813
  Description of Artificial Sequence: Synthetic polypeptide
  VH3-23_IGHD4-11*01(1)_1>2_IGHJ6*01

SEQ ID NO: 2816 - protein, 127 aa, Artificial Sequence; identical to SEQ ID NO: 2814
  Description of Artificial Sequence: Synthetic polypeptide
  VH3-23_IGHD4-11*01(1)_1>3_IGHJ6*01

SEQ ID NO: 2817 - protein, 127 aa, Artificial Sequence
  Description of Artificial Sequence: Synthetic polypeptide
  VH3-23_IGHD4-17*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGDYSYYYYYYGMDVWGQGTLVTVSSAS

SEQ ID NO: 2818 - protein, 127 aa, Artificial Sequence; identical to SEQ ID NO: 2814
  Description of Artificial Sequence: Synthetic polypeptide
  VH3-23_IGHD4-17*01>3_IGHJ6*01

SEQ ID NO: 2819 - protein, 128 aa, Artificial Sequence
  Description of Artificial Sequence: Synthetic polypeptide
  VH3-23_IGHD4-23*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDYGGNSSYYYYYYGMDVWGQGTLVTVSSAS

SEQ ID NO: 2820 - protein, 128 aa, Artificial Sequence
  Description of Artificial Sequence: Synthetic polypeptide
  VH3-23_IGHD4-23*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTTVVTSYYYYYYGMDVWGQGTLVTVSSAS

SEQ ID NO: 2821 - protein, 129 aa, Artificial Sequence
  Description of Artificial Sequence: Synthetic polypeptide
  VH3-23_IGHD5-5*01(2)_1>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDTAMVTSYYYYYYGMDVWGQGTLVTVSSAS

SEQ ID NO: 2822 - protein, 129 aa, Artificial Sequence
  Description of Artificial Sequence: Synthetic polypeptide
  VH3-23_IGHD5-5*01(2)_1>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWIQLWLRSYYYYYYGMDVWGQGTLVTVSSAS

SEQ ID NO: 2823 - protein, 129 aa, Artificial Sequence
  Description of Artificial Sequence: Synthetic polypeptide
  VH3-23_IGHD5-5*01(2)_1>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSYGYSYYYYYYGMDVWGQGTLVTVSSAS

SEQ ID NO: 2824 - protein, 130 aa, Artificial Sequence
  Description of Artificial Sequence: Synthetic polypeptide
  VH3-23_IGHD5-12*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVDIVATITSYYYYYYGMDVWGQGTLVTVSSAS

SEQ ID NO: 2825 - protein, 130 aa, Artificial Sequence
  Description of Artificial Sequence: Synthetic polypeptide
  VH3-23_IGHD5-12*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGYSGYDYSYYYYYYGMDVWGQGTLVTVSSAS

SEQ ID NO: 2826 - protein, 129 aa, Artificial Sequence; identical to SEQ ID NO: 2821
  Description of Artificial Sequence: Synthetic polypeptide
  VH3-23_IGHD5-18*01(2)_1>1_IGHJ6*01

SEQ ID NO: 2827 - protein, 129 aa, Artificial Sequence; identical to SEQ ID NO: 2822
  Description of Artificial Sequence: Synthetic polypeptide
  VH3-23_IGHD5-18*01(2)_1>2_IGHJ6*01

SEQ ID NO: 2828 - protein, 129 aa, Artificial Sequence; identical to SEQ ID NO: 2823
  Description of Artificial Sequence: Synthetic polypeptide
  VH3-23_IGHD5-18*01(2)_1>3_IGHJ6*01

SEQ ID NO: 2829 - protein, 129 aa, Artificial Sequence
  Description of Artificial Sequence: Synthetic polypeptide
  VH3-23_IGHD5-24*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVEMATITSYYYYYYGMDVWGQGTLVTVSSAS

SEQ ID NO: 2830 - protein, 129 aa, Artificial Sequence
  Description of Artificial Sequence: Synthetic polypeptide
  VH3-23_IGHD5-24*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRDGYNYSYYYYYYGMDVWGQGTLVTVSSAS

SEQ ID NO: 2831 - protein, 128 aa, Artificial Sequence
  Description of Artificial Sequence: Synthetic polypeptide
  VH3-23_IGHD6-6*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKEYSSSSSYYYYYYGMDVWGQGTLVTVSSAS

SEQ ID NO: 2832 - protein, 128 aa, Artificial Sequence
  Description of Artificial Sequence: Synthetic polypeptide
  VH3-23_IGHD6-6*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSIAARPSYYYYYYGMDVWGQGTLVTVSSAS

SEQ ID NO: 2833 - protein, 129 aa, Artificial Sequence
  Description of Artificial Sequence: Synthetic polypeptide
  VH3-23_IGHD6-13*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSSWYSYYYYYYGMDVWGQGTLVTVSSAS

SEQ ID NO: 2834 - protein, 129 aa, Artificial Sequence
  Description of Artificial Sequence: Synthetic polypeptide
  VH3-23_IGHD6-13*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAAGTSYYYYYYGMDVWGQGTLVTVSSAS

SEQ ID NO: 2835 - protein, 129 aa, Artificial Sequence
  Description of Artificial Sequence: Synthetic polypeptide
  VH3-23_IGHD6-19*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGWYSYYYYYYGMDVWGQGTLVTVSSAS

SEQ ID NO: 2836 - protein, 129 aa, Artificial Sequence
  Description of Artificial Sequence: Synthetic polypeptide
  VH3-23_IGHD6-19*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAVAGTSYYYYYYGMDVWGQGTLVTVSSAS

SEQ ID NO: 2837 - protein, 128 aa, Artificial Sequence
  Description of Artificial Sequence: Synthetic polypeptide
  VH3-23_IGHD6-25*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYSSGYSYYYYYYGMDVWGQGTLVTVSSAS

SEQ ID NO: 2838 - protein, 128 aa, Artificial Sequence
  Description of Artificial Sequence: Synthetic polypeptide
  VH3-23_IGHD6-25*01>2_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAATSYYYYYYGMDVWGQGTLVTVSSAS

SEQ ID NO: 2839 - protein, 126 aa, Artificial Sequence
  Description of Artificial Sequence: Synthetic polypeptide
  VH3-23_IGHD7-27*01>1_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKLTGESYYYYYYGMDVWGQGTLVTVSSAS

SEQ ID NO: 2840 - protein, 126 aa, Artificial Sequence
  Description of Artificial Sequence: Synthetic polypeptide
  VH3-23_IGHD7-27*01>3_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKANWGSYYYYYYGMDVWGQGTLVTVSSAS

SEQ ID NO: 2841 - protein, 128 aa, Artificial Sequence
  Description of Artificial Sequence: Synthetic polypeptide
  VH3-23_IGHD1-1*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVVPSYYYYYYGMDVWGQGTLVTVSSAS

SEQ ID NO: 2842 - protein, 128 aa, Artificial Sequence
  Description of Artificial Sequence: Synthetic polypeptide
  VH3-23_IGHD1-1*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSFQLYRSYYYYYYGMDVWGQGTLVTVSSAS

SEQ ID NO: 2843 - protein, 128 aa, Artificial Sequence
  Description of Artificial Sequence: Synthetic polypeptide
  VH3-23_IGHD1-1*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSCTSYYYYYYGMDVWGQGTLVTVSSAS

SEQ ID NO: 2844 - protein, 128 aa, Artificial Sequence
  Description of Artificial Sequence: Synthetic polypeptide
  VH3-23_IGHD1-7*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVPVIPSYYYYYYGMDVWGQGTLVTVSSAS

SEQ ID NO: 2845 - protein, 128 aa, Artificial Sequence
  Description of Artificial Sequence: Synthetic polypeptide
  VH3-23_IGHD1-7*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYTSYYYYYYGMDVWGQGTLVTVSSAS

SEQ ID NO: 2846 - protein, 128 aa, Artificial Sequence; identical to SEQ ID NO: 2844
  Description of Artificial Sequence: Synthetic polypeptide
  VH3-23_IGHD1-14*01>1'_IGHJ6*01

SEQ ID NO: 2847 - protein, 128 aa, Artificial Sequence
  Description of Artificial Sequence: Synthetic polypeptide
  VH3-23_IGHD1-14*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKWFRLYRSYYYYYYGMDVWGQGTLVTVSSAS

SEQ ID NO: 2848 - protein, 128 aa, Artificial Sequence
  Description of Artificial Sequence: Synthetic polypeptide
  VH3-23_IGHD1-14*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGGSGYTSYYYYYYGMDVWGQGTLVTVSSAS

SEQ ID NO: 2849 - protein, 128 aa, Artificial Sequence; identical to SEQ ID NO: 2844
  Description of Artificial Sequence: Synthetic polypeptide
  VH3-23_IGHD1-20*01>1'_IGHJ6*01

SEQ ID NO: 2850 - protein, 128 aa, Artificial Sequence; identical to SEQ ID NO: 2842
  Description of Artificial Sequence: Synthetic polypeptide
  VH3-23_IGHD1-20*01>2'_IGHJ6*01

SEQ ID NO: 2851 - protein, 128 aa, Artificial Sequence
  Description of Artificial Sequence: Synthetic polypeptide
  VH3-23_IGHD1-20*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRSSYTSYYYYYYGMDVWGQGTLVTVSSAS

SEQ ID NO: 2852 - protein, 129 aa, Artificial Sequence
  Description of Artificial Sequence: Synthetic polypeptide
  VH3-23_IGHD1-26*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVAPTIPSYYYYYYGMDVWGQGTLVTVSSAS

SEQ ID NO: 2853 - protein, 129 aa, Artificial Sequence
  Description of Artificial Sequence: Synthetic polypeptide
  VH3-23_IGHD1-26*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSHYTSYYYYYYGMDVWGQGTLVTVSSAS

SEQ ID NO: 2854 - protein, 132 aa, Artificial Sequence
  Description of Artificial Sequence: Synthetic polypeptide
  VH3-23_IGHD2-2*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAAGTTTISSYYYYYYGMDVWGQGTLVTVSSAS

SEQ ID NO: 2855 - protein, 132 aa, Artificial Sequence
  Description of Artificial Sequence: Synthetic polypeptide
  VH3-23_IGHD2-2*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGHSSWYYYNISYYYYYYGMDVWGQGTLVTVSSAS

SEQ ID NO: 2856 - protein, 132 aa, Artificial Sequence
  Description of Artificial Sequence: Synthetic polypeptide
  VH3-23_IGHD2-8*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAYTISTISSYYYYYYGMDVWGQGTLVTVSSAS

SEQ ID NO: 2857 - protein, 132 aa, Artificial Sequence
  Description of Artificial Sequence: Synthetic polypeptide
  VH3-23_IGHD2-15*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVAATTTTISSYYYYYYGMDVWGQGTLVTVSSAS

SEQ ID NO: 2858 - protein, 132 aa, Artificial Sequence
  Description of Artificial Sequence: Synthetic polypeptide
  VH3-23_IGHD2-15*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSSSYHHYNISYYYYYYGMDVWGQGTLVTVSSAS

SEQ ID NO: 2859 - protein, 131 aa, Artificial Sequence
  Description of Artificial Sequence: Synthetic polypeptide
  VH3-23_IGHD2-21*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIAITTTICSYYYYYYGMDVWGQGTLVTVSSAS

SEQ ID NO: 2860 - protein, 131 aa, Artificial Sequence
  Description of Artificial Sequence: Synthetic polypeptide
  VH3-23_IGHD2-21*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNSNHHHNMSYYYYYYGMDVWGQGTLVTVSSAS

SEQ ID NO: 2861 - protein, 132 aa, Artificial Sequence
  Description of Artificial Sequence: Synthetic polypeptide
  VH3-23_IGHD3-3*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGIITTPKIVISYYYYYYGMDVWGQGTLVTVSSAS

SEQ ID NO: 2862 - protein, 132 aa, Artificial Sequence
  Description of Artificial Sequence: Synthetic polypeptide
  VH3-23_IGHD3-3*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNHSKNRNSYYYYYYGMDVWGQGTLVTVSSAS

SEQ ID NO: 2863 - protein, 132 aa, Artificial Sequence
  Description of Artificial Sequence: Synthetic polypeptide
  VH3-23_IGHD3-9*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITSQNIVISYYYYYYGMDVWGQGTLVTVSSAS

SEQ ID NO: 2864 - protein, 132 aa, Artificial Sequence
  Description of Artificial Sequence: Synthetic polypeptide
  VH3-23_IGHD3-9*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNQSKYRNSYYYYYYGMDVWGQGTLVTVSSAS

SEQ ID NO: 2865 - protein, 132 aa, Artificial Sequence
  Description of Artificial Sequence: Synthetic polypeptide
  VH3-23_IGHD3-10*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIITPRTIVISYYYYYYGMDVWGQGTLVTVSSAS

SEQ ID NO: 2866 - protein, 132 aa, Artificial Sequence
  Description of Artificial Sequence: Synthetic polypeptide
  VH3-23_IGHD3-10*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYNNSPNHSNSYYYYYYGMDVWGQGTLVTVSSAS

SEQ ID NO: 2867 - protein, 134 aa, Artificial Sequence
  Description of Artificial Sequence: Synthetic polypeptide
  VH3-23_IGHD3-16*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGISITPPNVIIISYYYYYYGMDVWGQGTLVTVSSAS

SEQ ID NO: 2868 - protein, 134 aa, Artificial Sequence
  Description of Artificial Sequence: Synthetic polypeptide
  VH3-23_IGHD3-16*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGYKHNSPKRNHNSYYYYYYGMDVWGQGTLVTVSSAS

SEQ ID NO: 2869 - protein, 132 aa, Artificial Sequence
  Description of Artificial Sequence: Synthetic polypeptide
  VH3-23_IGHD3-22*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVITTTIIVISYYYYYYGMDVWGQGTLVTVSSAS

SEQ ID NO: 2870 - protein, 127 aa, Artificial Sequence
  Description of Artificial Sequence: Synthetic polypeptide
  VH3-23_IGHD4-4*01(1)_1>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVVTVVSYYYYYYGMDVWGQGTLVTVSSAS

SEQ ID NO: 2871 - protein, 127 aa, Artificial Sequence
  Description of Artificial Sequence: Synthetic polypeptide
  VH3-23_IGHD4-4*01(1)_1>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYCSSYYYYYYGMDVWGQGTLVTVSSAS

SEQ ID NO: 2872 - protein, 127 aa, Artificial Sequence; identical to SEQ ID NO: 2870
  Description of Artificial Sequence: Synthetic polypeptide
  VH3-23_IGHD4-11*01(1)_1>1'_IGHJ6*01

SEQ ID NO: 2873 - protein, 127 aa, Artificial Sequence; identical to SEQ ID NO: 2871
  Description of Artificial Sequence: Synthetic polypeptide
  VH3-23_IGHD4-11*01(1)_1>3'_IGHJ6*01

SEQ ID NO: 2874 - protein, 127 aa, Artificial Sequence; identical to SEQ ID NO: 2870
  Description of Artificial Sequence: Synthetic polypeptide
  VH3-23_IGHD4-17*01>1'_IGHJ6*01

SEQ ID NO: 2875 - protein, 127 aa, Artificial Sequence
  Description of Artificial Sequence: Synthetic polypeptide
  VH3-23_IGHD4-17*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSHRSSYYYYYYGMDVWGQGTLVTVSSAS

SEQ ID NO: 2876 - protein, 128 aa, Artificial Sequence
  Description of Artificial Sequence: Synthetic polypeptide
  VH3-23_IGHD4-23*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGVTTVVSYYYYYYGMDVWGQGTLVTVSSAS

SEQ ID NO: 2877 - protein, 128 aa, Artificial Sequence
  Description of Artificial Sequence: Synthetic polypeptide
  VH3-23_IGHD4-23*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSYHRSSYYYYYYGMDVWGQGTLVTVSSAS

SEQ ID NO: 2878 - protein, 129 aa, Artificial Sequence
  Description of Artificial Sequence: Synthetic polypeptide
  VH3-23_IGHD5-5*01(2)_1>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVTIAVSTSYYYYYYGMDVWGQGTLVTVSSAS

SEQ ID NO: 2879 - protein, 129 aa, Artificial Sequence
  Description of Artificial Sequence: Synthetic polypeptide
  VH3-23_IGHD5-5*01(2)_1>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNHSCIHSYYYYYYGMDVWGQGTLVTVSSAS

SEQ ID NO: 2880 - protein, 130 aa, Artificial Sequence
  Description of Artificial Sequence: Synthetic polypeptide
  VH3-23_IGHD5-12*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVATISTSYYYYYYGMDVWGQGTLVTVSSAS

SEQ ID NO: 2881 - protein, 130 aa, Artificial Sequence
  Description of Artificial Sequence: Synthetic polypeptide
  VH3-23_IGHD5-12*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNRSHYIHSYYYYYYGMDVWGQGTLVTVSSAS

SEQ ID NO: 2882 - protein, 129 aa, Artificial Sequence; identical to SEQ ID NO: 2878
  Description of Artificial Sequence: Synthetic polypeptide
  VH3-23_IGHD5-18*01(2)_1>1'_IGHJ6*01

SEQ ID NO: 2883 - protein, 129 aa, Artificial Sequence; identical to SEQ ID NO: 2879
  Description of Artificial Sequence: Synthetic polypeptide
  VH3-23_IGHD5-18*01(2)_1>3'_IGHJ6*01

SEQ ID NO: 2884 - protein, 129 aa, Artificial Sequence
  Description of Artificial Sequence: Synthetic polypeptide
  VH3-23_IGHD5-24*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVIVAISTSYYYYYYGMDVWGQGTLVTVSSAS

SEQ ID NO: 2885 - protein, 129 aa, Artificial Sequence
  Description of Artificial Sequence: Synthetic polypeptide
  VH3-23_IGHD5-24*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGNCSHLYSYYYYYYGMDVWGQGTLVTVSSAS

SEQ ID NO: 2886 - protein, 128 aa, Artificial Sequence
  Description of Artificial Sequence: Synthetic polypeptide
  VH3-23_IGHD6-6*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGRAAILSYYYYYYGMDVWGQGTLVTVSSAS

SEQ ID NO: 2887 - protein, 128 aa, Artificial Sequence
  Description of Artificial Sequence: Synthetic polypeptide
  VH3-23_IGHD6-6*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKDELLYSSYYYYYYGMDVWGQGTLVTVSSAS

SEQ ID NO: 2888 - protein, 128 aa, Artificial Sequence
  Description of Artificial Sequence: Synthetic polypeptide
  VH3-23_IGHD6-6*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCYTSYYYYYYGMDVWGQGTLVTVSSAS

SEQ ID NO: 2889 - protein, 129 aa, Artificial Sequence
  Description of Artificial Sequence: Synthetic polypeptide
  VH3-23_IGHD6-13*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPAAAIPSYYYYYYGMDVWGQGTLVTVSSAS

SEQ ID NO: 2890 - protein, 129 aa, Artificial Sequence
  Description of Artificial Sequence: Synthetic polypeptide
  VH3-23_IGHD6-13*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQLLLYPSYYYYYYGMDVWGQGTLVTVSSAS

SEQ ID NO: 2891 - protein, 129 aa, Artificial Sequence
  Description of Artificial Sequence: Synthetic polypeptide
  VH3-23_IGHD6-13*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSCCYTSYYYYYYGMDVWGQGTLVTVSSAS

SEQ ID NO: 2892 - protein, 129 aa, Artificial Sequence
  Description of Artificial Sequence: Synthetic polypeptide
  VH3-23_IGHD6-19*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVPATAIPSYYYYYYGMDVWGQGTLVTVSSAS

SEQ ID NO: 2893 - protein, 129 aa, Artificial Sequence
  Description of Artificial Sequence: Synthetic polypeptide
  VH3-23_IGHD6-19*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKYQPLLYPSYYYYYYGMDVWGQGTLVTVSSAS

SEQ ID NO: 2894 - protein, 129 aa, Artificial Sequence
  Description of Artificial Sequence: Synthetic polypeptide
  VH3-23_IGHD6-19*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGTSHCYTSYYYYYYGMDVWGQGTLVTVSSAS

SEQ ID NO: 2895 - protein, 128 aa, Artificial Sequence
  Description of Artificial Sequence: Synthetic polypeptide
  VH3-23_IGHD6-25*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKVAAAIPSYYYYYYGMDVWGQGTLVTVSSAS

SEQ ID NO: 2896 - protein, 128 aa, Artificial Sequence
  Description of Artificial Sequence: Synthetic polypeptide
  VH3-23_IGHD6-25*01>3'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKGSRCYTSYYYYYYGMDVWGQGTLVTVSSAS

SEQ ID NO: 2897 - protein, 126 aa, Artificial Sequence
  Description of Artificial Sequence: Synthetic polypeptide
  VH3-23_IGHD7-27*01>1'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKSPVRSYYYYYYGMDVWGQGTLVTVSSAS

SEQ ID NO: 2898 - protein, 126 aa, Artificial Sequence
  Description of Artificial Sequence: Synthetic polypeptide
  VH3-23_IGHD7-27*01>2'_IGHJ6*01
EVQLLESGGGLVQPGGSLRLSCAASGFTFSSYAMSWVRQAPGKGLEWVSSISGSGGSTYYADSVKGRFTISRDNSKNTLYLQMNSLRAEDTAVYYCAKPQLGSYYYYYYGMDVWGQGTLVTVSSAS

SEQ ID NO: 2899 - protein, 123 aa, Artificial Sequence
  Description of Artificial Sequence: Synthetic polypeptide
  VH5-51_IGHD5-18*01>3_IGHJ4*01 G100K/G104T Y27A
EVQLVQSGAEVKKPGESLKISCKGSGASFTSYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 2900 - protein, 123 aa, Artificial Sequence
  Description of Artificial Sequence: Synthetic polypeptide
  VH5-51_IGHD5-18*01>3_IGHJ4*01 G100K/G104T S31A
EVQLVQSGAEVKKPGESLKISCKGSGYSFTAYWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 2901 - protein, 123 aa, Artificial Sequence
  Description of Artificial Sequence: Synthetic polypeptide
  VH5-51_IGHD5-18*01>3_IGHJ4*01 G100K/G104T Y32A
EVQLVQSGAEVKKPGESLKISCKGSGYSFTSAWIGWVRQMPGKGLEWMGIIYPGDSDTRYSPSFQGQVTISADKSISTAYLQWSSLKASDTAMYYCARRKYSYTYDYFDYWGQGTLVTVSSAS

SEQ ID NO: 2902 - protein, 123 aa, Artificial Sequence
  Description of Artificial Sequence: Synthetic polypeptide
  VH5-51_IGHD5-18*01>3_IGHJ4*01 G100K/G104T G54A
EVQLVQSGAEVKKPGESLKISCKGSGYSFTSYWIGWVRQMPGKGLEWMGIIYPADSDTRYSPSFQGQVTISADKSISTAYLQWSSLKASDTAMYYCARRKYSYTYDYFDYWGQGTLVTVSSAS

SEQ ID NO: 2903 - protein, 123 aa, Artificial Sequence
  Description of Artificial Sequence: Synthetic polypeptide
  VH5-51_IGHD5-18*01>3_IGHJ4*01 G100K/G104T S56A
EVQLVQSGAEVKKPGESLKISCKGSGYSFTSYWIGWVRQMPGKGLEWMGIIYPGDADTRYSPSFQGQVTISADKSISTAYLQWSSLKASDTAMYYCARRKYSYTYDYFDYWGQGTLVTVSSAS

SEQ ID NO: 2904 - protein, 685 aa, Homo sapiens
  hDLL4
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 2905 - DNA, 2678 bp, Homo sapiens
  hDLL4 cDNA
aggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccac

SEQ ID NO: 2906 - protein, 2555 aa, Homo sapiens
  Notch-1 (P46531)
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 2907 - protein, 2003 aa, Homo sapiens
  Notch-4 (Q99466)
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 2908 - protein, 10 aa, Artificial Sequence
  Description of Artificial Sequence: Synthetic peptide
  CDRH1
GYTFTSYYMH

SEQ ID NO: 2909 - protein, 17 aa, Artificial Sequence
  Description of Artificial Sequence: Synthetic peptide
  CDRH2
IINPSGGSTSYAQKFQG

SEQ ID NO: 2910 - protein, 13 aa, Artificial Sequence
  Description of Artificial Sequence: Synthetic peptide
  CDRH3
EEYSSSSAEYFQH

SEQ ID NO: 2911 - protein, 11 aa, Artificial Sequence
  Description of Artificial Sequence: Synthetic peptide
  CDRL1
RASQSVSSYLA

SEQ ID NO: 2912 - protein, 7 aa, Artificial Sequence
  Description of Artificial Sequence: Synthetic peptide
  CDRL2
DASNRAT

SEQ ID NO: 2913 - protein, 10 aa, Artificial Sequence
  Description of Artificial Sequence: Synthetic peptide
  CDRL3
QQRSNWPPWT

SEQ ID NO: 2914 - protein, 10 aa, Artificial Sequence
  Description of Artificial Sequence: Synthetic peptide
  CDRH1
GYSFTSYWIG

SEQ ID NO: 2915 - protein, 17 aa, Artificial Sequence
  Description of Artificial Sequence: Synthetic peptide
  CDRH2
IIYPGDSDTRYSPSFQG

SEQ ID NO: 2916 - protein, 12 aa, Artificial Sequence
  Description of Artificial Sequence: Synthetic peptide
  CDRH3
RGYSYGYDYFDY

SEQ ID NO: 2917 - protein, 14 aa, Artificial Sequence
  Description of Artificial Sequence: Synthetic peptide
  CDRL1
GLSSGSVSTSYYPS

SEQ ID NO: 2918 - protein, 7 aa, Artificial Sequence
  Description of Artificial Sequence: Synthetic peptide
  CDRL2
STNTRSS

SEQ ID NO: 2919 - protein, 11 aa, Artificial Sequence
  Description of Artificial Sequence: Synthetic peptide
  CDRL3
VLYMGSGISYV

SEQ ID NO: 2920 - protein, 5 aa, Artificial Sequence
  Description of Artificial Sequence: Synthetic peptide
  CDRH1
SYYMH

SEQ ID NO: 2921 - protein, 5 aa, Artificial Sequence
  Description of Artificial Sequence: Synthetic peptide
  CDRH1
SYWIG

SEQ ID NO: 2922 - protein, 330 aa, Artificial Sequence [sequence omitted]

SEQ ID NO: 2923 - protein, 107 aa, Artificial Sequence [sequence omitted]

SEQ ID NO: 2924 - protein, 106 aa, Artificial Sequence
  Description of Artificial Sequence: Synthetic polypeptide
  CL Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2925 - protein, 377 aa, Homo sapiens
  Constant region heavy chain IgG3
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 2926 - protein, 352 aa, Homo sapiens
  IgA from NCBI J00220
SPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 2927 - protein, 353 aa, Homo sapiens
  IgA from Uniprot P01876
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 2928 - protein, 452 aa, Homo sapiens
  IgM Uniprot P01871
GSASAPTLFPLVSCENSPSDTSSVAVGCLAQDFLPDSITLSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVAHEALPNRVTERTVDKSTGKPTLYNVSLVMSDTAGTCY

SEQ ID NO: 2929 - protein, 453 aa, Homo sapiens [sequence omitted]

SEQ ID NO: 2930 - protein, 137 aa, Homo sapiens
  Human mature J chain
QEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 2931 - protein, 137 aa, Artificial Sequence
  Description of Artificial Sequence: Synthetic polypeptide
  Mutant form of human mature J chain with C134S mutation compared to wild type Mature form of human J chain (SEQ ID NO:2930)
QEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDASYPD

SEQ ID NO: 2932 - protein, 112 aa, Artificial Sequence
  Description of Artificial Sequence: Synthetic polypeptide
  Mutant form of human mature J chain with amino acids 113-137 deleted compared to wild type Mature form of human J chain (SEQ ID NO:2930)
QEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTA

SEQ ID NO: 2933 - protein, 137 aa, Artificial Sequence
  Mutant form of human mature J chain with C109S and C134S mutation compared to wild type mature form of human J chain (SEQ ID NO:2930)
QEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKSYTAVVPLVYGGETKMVETALTPDASYPD

SEQ ID NO: 2934 - DNA, 3519 bp, Artificial Sequence
  Description of Artificial Sequence: Synthetic polynucleotide
  pCR-BluntII TOPO plasmid
agcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacactatagaatactcaagctatgcatcaagcttggtaccgagctcggatccactagtaacggccgccagtgtgctggaattcgcccttaagggcgaattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaag

SEQ ID NO: 2935 - DNA, 5070 bp, Artificial Sequence
  pcDNA5/FRT
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtacctagaagttcctattccgaagttcctattctctagaaagtataggaacttccttggccaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtactacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 2936 - DNA, 5785 bp, Artificial Sequence
  Description of Artificial Sequence: Synthetic polynucleotide
  pOG44
ccgcggtctttcggacttttgaaagtgatggtggtgggggaaggattcgaaccttcgaagtcgatgacggcagatttagagtctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttctagaattcgctgtctgcgagggccagctgttggggtgagtactccctctcaaaagcgggcatgacttctgcgctaagattgtcagtttccaaaaacgaggaggatttgatattcacctggcccgcggtgatgcctttgagggtggccgcgtccatctggtcagaaaagacaatctttttgttgtcaagcttgaggtgtggcaggcttgagatctggccatacacttgagtgacaatgacatccactttgcctttctctccacaggtgtccactcccaggtccaactgcagcccaagcttccaccatgccacaatttgatatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagtttggatattgtcaacaagtcactgcagtttaaatacaagacgcaaaaagcaacaattctggaagcctcattaaagaaattgattcctgcttgggaatttacaattattccttactatggacaaaaacatcaatctgatatcactgatattgtaagtagtttgcaattacagttcgaatcatcggaagaagcagataagggaaatagccacagtaaaaaaatgcttaaagcacttctaagtgagggtgaaagcatctgggagatcactgagaaaatactaaattcgtttgagtatacttcgagatttacaaaaacaaaaactttataccaattcctcttcctagctactttcatcaattgtggaagattcagcgatattaagaacgttgatccgaaatcatttaaattagtccaaaataagtatctgggagtaataatccagtgtttagtgacagagacaaagacaagcgttagtaggcacatatacttctttagcgcaaggggtaggatcgatccacttgtatatttggatgaatttttgaggaattctgaaccagtcctaaaacgagtaaataggaccggcaattcttcaagcaacaagcaggaataccaattattaaaagataacttagtcagatcgtacaacaaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcatatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgggtaccgagctcctcgaggatcagacatgataagatacattgatgagtttggacaaaccacaactagaatgcagtgaaaaaaatgctttatttgtgaaatttgtgatgctattgctttatttgtaaccattataagctgcaataaacaagttatcctcgaggagctcatgagcgcttgtttcggcgtgggtatggtggcaggcccgtggccgggggactgttgggcgccatctccttgcatgcaccattccttgcggcggcggtgctcaacggcctcaacctactactgggctgcttcctaatgcaggagtcgcataagggagagcgtcgacctcgagggggggcccggtacccagcttttgttccctttagtgagggttaattgcgcgcttggcgtaatcatggtcatagctgtttcctgtgtgaaattgttatccgctcacaattccacacaacatacgagccgggagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcttcgggaagcgtggcgctttctcatagctcacgctgtaggtatctcagttcggtgtaggtcgttcgctccaagctgggctgtgtgcacgaaccccccgttcagcccgaccctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacttcggaaaaagagttggtagctcttgatccggcaaacaaaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccactaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctcca

SEQ ID NO: 2937 - protein, 326 aa, Homo sapiens
  IgG2
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2938 - DNA, 4188 bp, Artificial Sequence
  Description of Artificial Sequence: Synthetic polynucleotide
  pFUSE-hlgG2-Fc2
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgatatcggccatggttagatctgtggagtgcccaccttgcccagcaccacctgtggcaggaccttcagtcttcctcttccccccaaaacccaaggacaccctgatgatctccagaacccctgaggtcacgtgcgtggtggtggacgtgagccacgaagaccccgaggtccagttcaactggtacgtggacggcatggaggtgcataatgccaagacaaagccacgggaggagcagttcaacagcacgttccgtgtggtcagcgtcctcaccgtcgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacacagaagagcctctccctgtctccgggtaaatgagtgccacggctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 2939 - DNA, 259 bp, Artificial Sequence
  Description of Artificial Sequence: Synthetic polynucleotide
  P6xCBF
ggtacctgagctcgctagcgatctggtgtaaacacgccgtgggaaaaaatttatggatctggtgtaaacacgccgtgggaaaaaatttatggagctcgctagcgatctggtgtaaacacgccgtgggaaaaaatttatggatctggtgtaaacacgccgtgggaaaaaatttatgctcgaggatctggtgtaaacacgccgtgggaaaaaatttatggatctggtgtaaacacgccgtgggaaaaaatttatgaagctt

SEQ ID NO: 2940 - DNA, 5882 bp, Artificial Sequence
  Description of Artificial Sequence: Synthetic polynucleotide
  pGL4.26
ggcctaactggccggtacctgagctcgctagcctcgaggatatcaagatctggcctcggcggccaagcttagacactagagggtatataatggaagctcgacttccagcttggcaatccggtactgttggtaaagccaccatggaagatgccaaaaacattaagaagggcccagcgccattctacccactcgaagacgggaccgccggcgagcagctgcacaaagccatgaagcgctacgccctggtgcccggcaccatcgcctttaccgacgcacatatcgaggtggacattacctacgccgagtacttcgagatgagcgttcggctggcagaagctatgaagcgctatgggctgaatacaaaccatcggatcgtggtgtgcagcgagaatagcttgcagttcttcatgcccgtgttgggtgccctgttcatcggtgtggctgtggccccagctaacgacatctacaacgagcgcgagctgctgaacagcatgggcatcagccagcccaccgtcgtattcgtgagcaagaaagggctgcaaaagatcctcaacgtgcaaaagaagctaccgatcatacaaaagatcatcatcatggatagcaagaccgactaccagggcttccaaagcatgtacaccttcgtgacttcccatttgccacccggcttcaacgagtacgacttcgtgcccgagagcttcgaccgggacaaaaccatcgccctgatcatgaacagtagtggcagtaccggattgcccaagggcgtagccctaccgcaccgcaccgcttgtgtccgattcagtcatgcccgcgaccccatcttcggcaaccagatcatccccgacaccgctatcctcagcgtggtgccatttcaccacggcttcggcatgttcaccacgctgggctacttgatctgcggctttcgggtcgtgctcatgtaccgcttcgaggaggagctattcttgcgcagcttgcaagactataagattcaatctgccctgctggtgcccacactatttagcttcttcgctaagagcactctcatcgacaagtacgacctaagcaacttgcacgagatcgccagcggcggggcgccgctcagcaaggaggtaggtgaggccgtggccaaacgcttccacctaccaggcatccgccagggctacggcctgacagaaacaaccagcgccattctgatcacccccgaaggggacgacaagcctggcgcagtaggcaaggtggtgcccttcttcgaggctaaggtggtggacttggacaccggtaagacactgggtgtgaaccagcgcggcgagctgtgcgtccgtggccccatgatcatgagcggctacgttaacaaccccgaggctacaaacgctctcatcgacaaggacggctggctgcacagcggcgacatcgcctactgggacgaggacgagcacttcttcatcgtggaccggctgaagagcctgatcaaatacaagggctaccaggtagccccagccgaactggagagcatcctgctgcaacaccccaacatcttcgacgccggggtcgccggcctgcccgacgacgatgccggcgagctgcccgccgcagtcgtcgtgctggaacacggtaaaaccatgaccgagaaggagatcgtggactatgtggccagccaggttacaaccgccaagaagctgcgcggtggtgttgtgttcgtggacgaggtgcctaaaggactgaccggcaagttggacgcccgcaagatccgcgagattctcattaaggccaagaagggcggcaagatcgccgtgtaataattctagagtcggggcggccggccgcttcgagcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataaggatccgtttgcgtattgggcgctcttccgctgatctgcgcagcaccatggcctgaaataacctctgaaagaggaacttggttagctaccttctgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcgattcttctgacactagcgccaccatgaagaagcccgaactcaccgctaccagcgttgaaaaatttctcatcgagaagttcgacagtgtgagcgacctgatgcagttgtcggagggcgaagagagccgagccttcagcttcgatgtcggcggacgcggctatgtactgcgggtgaatagctgcgctgatggcttctacaaagaccgctacgtgtaccgccacttcgccagcgctgcactacccatccccgaagtgttggacatcggcgagttcagcgagagcctgacatactgcatcagtagacgcgcccaaggcgttactctccaagacctccccgaaacagagctgcctgctgtgttacagcctgtcgccgaagctatggatgctattgccgccgccgacctcagtcaaaccagcggcttcggcccattcgggccccaaggcatcggccagtacacaacctggcgggatttcatttgcgccattgctgatccccatgtctaccactggcagaccgtgatggacgacaccgtgtccgccagcgtagctcaagccctggacgaactgatgctgtgggccgaagactgtcccgaggtgcgccacctcgtccatgccgacttcggcagcaacaacgtcctgaccgacaacggccgcatcaccgccgtaatcgactggtccgaagctatgttcggggacagtcagtacgaggtggccaacatcttcttctggcggccctggctggcttgcatggagcagcagactcgctacttcgagcgccggcatcccgagctggccggcagccctcgtctgcgagcctacatgctgcgcatcggcctggatcagctctaccagagcctcgtggacggcaacttcgacgatgctgcctgggctcaaggccgctgcgatgccatcgtccgcagcggggccggcaccgtcggtcgcacacaaatcgctcgccggagcgcagccgtatggaccgacggctgcgtcgaggtgctggccgacagcggcaaccgccggcccagtacacgaccgcgcgctaaggaggtaggtcgagtttaaactctagaaccggtcatggccgcaataaaatatctttattttcattacatctgtgtgttggttttttgtgtgttcgaactagatgctgtcgaccgatgcccttgagagccttcaacccagtcagctccttccggtgggcgcggggcatgactatcgtcgccgcacttatgactgtcttctttatcatgcaactcgtaggacaggtgccggcagcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagcggccgcaaatgctaaaccactgcagtggttaccagtgcttgatcagtgaggcaccgatctcagcgatctgcctatttcgttcgtccatagtggcctgactccccgtcgtgtagatcactacgattcgtgagggcttaccatcaggccccagcgcagcaatgatgccgcgagagccgcgttcaccggcccccgatttgtcagcaatgaaccagccagcagggagggccgagcgaagaagtggtcctgctactttgtccgcctccatccagtctatgagctgctgtcgtgatgctagagtaagaagttcgccagtgagtagtttccgaagagttgtggccattgctactggcatcgtggtatcacgctcgtcgttcggtatggcttcgttcaactctggttcccagcggtcaagccgggtcacatgatcacccatattatgaagaaatgcagtcagctccttagggcctccgatcgttgtcagaagtaagttggccgcggtgttgtcgctcatggtaatggcagcactacacaattctcttaccgtcatgccatccgtaagatgcttttccgtgaccggcgagtactcaaccaagtcgttttgtgagtagtgtatacggcgaccaagctgctcttgcccggcgtctatacgggacaacaccgcgccacatagcagtactttgaaagtgctcatcatcgggaatcgttcttcggggcggaaagactcaaggatcttgccgctattgagatccagttcgatatagcccactcttgcacccagttgatcttcagcatcttttactttcaccagcgtttcggggtgtgcaaaaacaggcaagcaaaatgccgcaaagaagggaatgagtgcgacacgaaaatgttggatgctcatactcgtcctttttcaatattattgaagcatttatcagggttactagtacgtctctcaaggataagtaagtaatattaaggtacgggaggtattggacaggccgcaataaaatatctttattttcattacatctgtgtgttggttttttgtgtgaatcgatagtactaacatacgctctccatcaaaacaaaacgaaacaaaacaaactagcaaaataggctgtccccagtgcaagtgcaggtgccagaacatttctct

SEQ ID NO: 2941 - protein, 109 aa, Artificial Sequence; identical to SEQ ID NO: 2198
  Description of Artificial Sequence: Synthetic polypeptide
  gnl|Fabrus|V2-17_IGLJ2*01 Protein

The invention claimed is:

1. A method of affinity maturation of a first antibody for a target antigen, comprising:
   a) identifying a related antibody that exhibits a reduced affinity for the target antigen than the corresponding form of a first antibody by screening a spatially addressable combinatorial antibody library, wherein the related antibody contains a related variable heavy chain or a related variable light chain that is either:
      one in which the corresponding variable heavy chain and variable light chain of the related antibody exhibits at least 75% amino acid sequence identity to the corresponding variable heavy chain or variable light chain of the first antibody but does not exhibit 100% sequence identity therewith; or
      one in which at least one of the $V_H$, $D_H$, and $J_H$ germline segments of a nucleic acid molecule encoding the variable heavy chain of the related antibody is from the same gene family as one of the $V_H$, $D_H$, and $J_H$ germline segments of the nucleic acid molecule encoding the variable heavy chain of the first antibody and at least one of the $V_\kappa$ and $J_\kappa$ or at least one of the $V_\lambda$ and $J_\lambda$ germline segments of the nucleic acid molecule encoding the variable light chain is from the same gene family as to one of the $V_\kappa$ and $J_\kappa$ or $V_\lambda$ and $J_\lambda$ germline segments of the nucleic acid molecule encoding the variable light chain of the first antibody; and
   b) comparing the amino acid sequence of the variable heavy chain or variable light chain of the first antibody to the amino acid sequence of the corresponding related variable heavy chain or variable light chain of the related antibody;
   c) identifying a target region within the variable heavy chain or variable light chain of a first antibody wherein the target region exhibits at least one amino acid difference compared to the same region in the related antibody;
   d) producing a plurality of modified antibodies each comprising a variable heavy chain and a variable light chain wherein at least one of the variable heavy chain or variable light chain is modified in its target region by replacement of a single amino acid residue, whereby the target region in each of the plurality of antibodies contains replacement of an amino acid to a different amino acid compared to the first antibody;
   e) screening each of the plurality of modified antibodies for an affinity to the target antigen; and
   f) selecting those modified antibodies that exhibit increased affinity for the target antigen compared to the first antibody.

2. A method according to claim 1, wherein the plurality of modified antibodies in part (d) are produced by producing a plurality of nucleic acid molecules that encode modified forms of a variable heavy chain or a variable light chain of the first antibody, wherein the nucleic acid molecules contain one codon encoding an amino acid in the target region that encodes a different amino acid as compared to the unmodified variable heavy or variable light chain, whereby each nucleic acid molecule of the plurality encodes a variable heavy chain or variable light chain that is modified in its target region by replacement of a single amino acid residue.

3. A method according to claim 1, wherein the variable heavy chain or variable light chain of the first antibody exhibits at least 75% or more sequence identity with the corresponding related variable heavy chain or variable light chain of the related antibody; 75% to 99% of the sequence identity with the corresponding related variable heavy chain or variable light chain of the related antibody, or at least or about 80%, 85%, 90%, 91%, 92%, 93%, 94%, 95%, 96%, 97%, 98%, 99%, sequence identity with the corresponding related variable heavy chain or variable light chain of the related antibody.

4. A method according to claim 1, wherein the target region is selected from the group consisting of a CDR1, CDR2, CDR3, FR1, FR2, FR3, and FR4.

5. A method according to claim 1, wherein:
   a) the first antibody is identified by screening a spatially addressable combinatorial antibody library or spatially addressable combinatorial antigen-binding antibody fragment library;
   b) the spatially addressable combinatorial library is produced by a method comprising:
      i) combining a $V_H$, a $D_H$, and a $J_H$ human germline segment or portion thereof in frame to generate a sequence of a nucleic acid molecule encoding a VH chain;
      ii) combining a $V_\kappa$ and a $J_\kappa$ human germline segment or portion thereof, or a $V_\lambda$ and a $J_\lambda$ germline segment or portion thereof in frame to generate a sequence of a nucleic acid molecule encoding a VL chain, wherein:
         in steps i) and ii), each of the portions of the $V_H$, $D_H$, $J_H$, $V_\kappa$, $J_\kappa$, $V_\lambda$ or $J_\lambda$ are sufficient to produce an antibody containing a VH or VL that forms a sufficient antigen binding site;
      iii) repeating steps i) and ii) a plurality of times to generate sequences of a plurality of different nucleic acid molecules;
      iv) synthesizing the nucleic acid molecules to produce two libraries, wherein:
         the first library comprises nucleic acid molecules encoding a VH chain; and
         the second library comprises nucleic acid molecules encoding a VL chain;
      v) introducing a nucleic acid molecule from the first library and from the second library into a cell and repeating this a plurality of times to produce a library of cells, wherein each cell contains nucleic acid molecules encoding a different combination of VH and VL from at least some of the other cells in the library of cells; and
      vi) growing the cells to express the antibodies thereby producing a plurality of antibodies, wherein the different antibodies in the library each comprise a different combination of a VH and a VL chain to form an antigen binding site; and
   c) screening of the library is effected by:
      i) contacting an antibody in the library with a target protein;
      ii) assessing binding of the antibody with the target protein and/or whether the antibody modulates a functional activity of the target protein; and
      iii) identifying an antibody that exhibits an affinity for the target protein, wherein the identified antibody is a first antibody.

6. A method according to claim 5 that further includes at least one of the following:
   a) the related antibody also is identified by screening a spatially addressable combinatorial antibody library by steps a)-c), whereby the related antibody exhibits reduced activity for the target antigen compared to the first antibody;

b) the library is a spatially addressable library, whereby:
in step iv), the synthesized nucleic acid sequences are individually addressed, thereby generating a first addressed nucleic acid library and a second addressed nucleic acid library;
in step v), the cells are addressed, wherein each locus comprises a cell that contains nucleic acid molecules encoding a different combination of a VH and a VL from every other cell in the addressed library of cells; and
in step vi) the plurality of antibodies are addressed, wherein:
the antibodies at each locus in the library are the same antibody and are different from those at each and every other locus;
and the identity of the antibody is known by its address, wherein optionally the antibodies in the addressable library are arranged in a spatial array, optionally a multiwell plate, wherein each individual locus of the array corresponds to a different antibody member;
c) wherein the antibodies are in an addressable library, wherein optionally the antibodies in the addressable library are arranged in a spatial array, optionally a multiwell plate, wherein optionally each individual locus of the array corresponds to a different antibody member are attached to a solid support selected from the group consisting of a filter, chip, slide, bead or cellulose, and the different antibody members are immobilized to the surface thereof;
d) wherein the plurality of nucleic acid molecules are generated by a method selected from the group consisting of PCR mutagenesis, cassette mutagenesis, site-directed mutagenesis, random point mutagenesis, mutagenesis using uracil containing templates, oligonucleotide-directed mutagenesis, phosphorothioate-modified DNA mutagenesis, mutagenesis using gapped duplex DNA, point mismatch repair, mutagenesis using repair-deficient hast strains, restriction-selection and restriction-purification, deletion mutagenesis, mutagenesis by total gene synthesis, and double-strand break repair; or
e) wherein the plurality of nucleic acid molecules are generated by a method selected from the group consisting of NNK, NNS, NNN, NNY, or NNR mutagenesis.

7. A method according to claim 1, further comprising before step d),
g) performing scanning mutagenesis of the first antibody comprising producing a plurality of modified antibodies comprising a variable heavy chain and a variable light chain, wherein at least one of the variable heavy chain or variable light chain is one that is modified by replacement of a single amino acid residue with a scanned amino acid residue in the target region, whereby each of the plurality of antibodies contains replacement of an amino acid in the target region compared to the first antibody, wherein the scanned amino acid optionally is selected from the group consisting of alanine, threonine, proline, glycine, and a non-natural amino acid;
h) screening each of the plurality of modified antibodies for an affinity to the target antigen; and
i) selecting a second antibody from among the modified antibodies that exhibits retained or increased affinity for the target antigen compared to the first antibody not containing the amino acid replacement, whereby the second antibody is used in place of the first antibody in step b).

8. A method according to claim 7 that further includes at least one of the following:
a) wherein the plurality of modified antibodies in step g) are produced by producing a plurality of nucleic acid molecules that encode modified forms of a variable heavy chain or a variable light chain of the first antibody containing the target region, wherein the nucleic acid molecules contain one codon that encodes a scanned amino acid in the target region compared to the corresponding codon of the unmodified variable heavy or variable light chain that does not encode the scanned amino acid, whereby each nucleic acid molecule of the plurality encodes a variable heavy chain or variable light chain that is modified by replacement of a single amino acid residue to the same scanned amino acid residue in the target region;
b) wherein a second antibody is selected that exhibits an affinity that is at least 75% or more of the affinity of the corresponding form of the first antibody; is at least 75% to 200% of the affinity of the corresponding form of the first antibody; or is at least or about 75%, 80%, 85%, 90%, 95%, 100%, 105%, 110%, 115%, 120%, 130%, 140%, 150%, 200% or more of the affinity of the corresponding form of the first antibody;
c) further comprising after step i) determining the amino acid residue position that is modified in the second antibody to contain a neutral amino acid compared to the first antibody not containing the amino acid replacement;
d) wherein a subset of the amino acid residues in the target region are modified by amino acid replacement to a scanned amino acid;
e) wherein only the amino acid residues that differ between the first antibody and related antibody in the target region are modified by amino acid replacement to a scanned amino acid;
f) wherein all of the amino acids in the target region are modified by amino acid replacement to a scanned amino acid;
g) wherein the selected modified antibody exhibits about 2-fold, 5-fold, 10-fold, 100-fold, 200-fold, 300-fold, 400-fold, 500-fold, 600-fold, 700-fold, 800-fold, 900-fold, 1000-fold, 2000-fold, 3000-fold, 4000-fold, 5000-fold, 10000-fold, or more improved activity for the target antigen compared to the first antibody; or
h) wherein the modified antibody exhibits a binding affinity that is greater than the binding affinity of the first antibody and is about $1\times10^{-9}$ M or less; $1\times10^{-9}$ M to $1\times10^{-11}$ M; or is or is about $1\times10^{-9}$ M, $2\times10^{-9}$ M, $3\times10^{-9}$ M, $4\times10^{-9}$ M, $5\times10^{-9}$ M, $6\times10^{-9}$ M, $7\times10^{-9}$ M, $8\times10^{-9}$ M, $9\times10^{-9}$ M, $1\times10^{-10}$ M, $2\times10^{-10}$ M, $3\times10^{-10}$ M, $4\times10^{-10}$ M, $5\times10^{-10}$ M, $6\times10^{-10}$ M, $7\times10^{-10}$ M, $8\times10^{-10}$ M, $9\times10^{-10}$ M, or less.

9. A method according to claim 1, comprising:
performing steps a)-f) on the variable heavy chain of the first antibody and selecting first modified antibodies each containing an amino acid replacement in the target region;
performing steps a)-f) independently and separately on the variable light chain of the first antibody and selecting second modified antibodies each containing an amino acid replacement in the target region;
combining the variable heavy chain of a first modified antibody with the variable light chain of a second modified antibody to generate a plurality of different third modified antibodies each comprising an amino acid replacement in the target region of the variable heavy chain and variable light chain; and screening each of the plurality of third modified antibodies for binding to the target antigen; and selecting those third modified antibodies that exhibit an increased affinity for the target antigen compared to the first and second modified antibodies.

10. A method according to claim 1, further comprising after selecting a first modified antibody in step f):
j) selecting another different region within the variable heavy chain or variable light chain of the first modified antibody for further mutagenesis, wherein optionally the further different region is selected from the group consisting of a CDR1, CDR2, CDR3, FR1, FR2, FR3, and FR4;
k) producing a plurality of nucleic acid molecules that encode modified forms of the variable heavy chain or variable light chain of the first modified antibody, wherein the nucleic acid molecules contain one codon encoding an amino acid in the selected region that encodes a different amino acid from the first modified variable heavy or variable light chain, whereby each nucleic acid molecule of the plurality encodes a variable heavy chain or variable light chain that is modified in the selected region by replacement of a single amino acid residue;
l) producing a plurality of further modified antibodies each comprising a variable heavy chain and a variable light chain, wherein at least one of the variable heavy chain or variable light chain is one produced in step k), whereby the selected region in each of the plurality of antibodies contains replacement of an amino acid to a different amino acid compared to the first modified antibody;
m) screening each of the plurality of further modified antibodies for binding to the target antigen; and
n) selecting those further modified antibodies that exhibit increased affinity for the target antigen compared to the first modified antibody.

11. A method according to claim 1, wherein the target region in the first antibody exhibits 1, 2, 3, 4, 5, 6, 7, 8, 9, or 10 amino acid differences compared to the corresponding region in the related antibody.

12. A method according to claim 1, wherein the related antibody is 1, 2, 3, 4, or 5 related antibodies.

13. A method according to claim 1, wherein the affinity is assessed by a method selected from the group consisting of an immunoassay, optionally an immunoassay selected from the group consisting of a radioimmunoassay, an enzyme linked immunosorbent assay (ELISA), and an electrochemiluminescence assay, wherein the electrochemiluminescence assay optionally is meso-scale discovery (MSD); whole cell panning; and surface Plasmon resonance (SPR).

14. A method according to claim 1, wherein the first antibody binds to the target antigen when in a Fab form with a binding affinity that is about $10^{-4}$ M or lower, about $10^{-4}$ M to about $10^{-8}$ M, or at or about $10^{-4}$ M, $10^{-5}$ M, $10^{-6}$ M, $10^{-7}$ M, $10^{-8}$ M, or lower.

15. A method according to claim 1, wherein the related antibody exhibits a binding affinity that is less than the binding affinity of the first antibody, or antigen-binding portion thereof, whereby the binding affinity of the related antibody in its Fab form is about $10^{-4}$ M or lower; about $10^{-4}$ M to about $10^{-8}$ M; or at or about $10^{-4}$ M, $10^{-5}$ M, $10^{-6}$ M, $10^{-7}$ M, $10^{-8}$ M, or lower.

16. A method according to claim 1, wherein the related antibody exhibits about 80% or less affinity than the corresponding form of the first antibody about 5% to about 80% of the affinity of the corresponding form of the first antibody; or less than or about 80%, 70%, 60%, 50%, 40%, 30%, 20%, 10%, 5%, or less affinity than the corresponding form of the first antibody.

17. A method according to claim 1, wherein the related antibody exhibits the same or similar level of affinity to the target antigen compared to a negative control.

18. A method according to claim 1, wherein the target region is identified within the variable heavy chain of the first antibody and steps d)-f) are performed therefrom.

19. A method according to claim 1, wherein the target region is identified within the variable light chain of the first antibody and steps d)-f) are performed therefrom.

20. A method according to claim 1, wherein a target region is identified within the variable heavy chain of the first antibody and steps d)-f) are performed therefrom; and
separately and independently a target region is identified within the variable light chain of the first antibody and steps d)-f) are performed therefrom.

21. A method according to claim 1, wherein a related antibody that contains the related corresponding variable heavy chain is different than a related antibody that contains the related corresponding variable light chain.

22. A method according to claim 1, wherein a related antibody that contains the related corresponding variable heavy chain is the same as a related antibody that contains the related corresponding variable light chain.

23. A method according to claim 1, wherein the amino acid sequence of the variable heavy chain or variable light chain of the first antibody exhibits at least about 80% or more sequence identity with the corresponding amino acid sequence of the related variable heavy chain or variable light chain of the related antibody; about 80% to about 99% of the sequence identity with the corresponding amino acid sequence of the related variable heavy chain or variable light chain of the related antibody; or at least or about 80%, 85%, 90%, 91%, 92%, 93%, 94%, 95%, 96%, 97%, 98%, or 99% sequence identity with the corresponding amino acid sequence of the related variable heavy chain or variable light chain of the related antibody.

24. A method according to claim 1, wherein the variable heavy chain or variable light chain of the first antibody exhibits at least about 95% sequence identity with the corresponding amino acid sequence of the related variable heavy chain or variable light chain of the related antibody.

25. A method according to claim 1, wherein the related antibody contains a related variable heavy chain or variable light chain that is one in which at least one of the $V_H$, $D_H$, and $J_H$ germline segments of the nucleic acid molecule encoding the variable heavy chain of the first antibody is identical to one of the $V_H$, $D_H$, and $J_H$ germline segments of the nucleic acid molecule encoding the variable heavy chain of the related antibody; and at least one of the $V_\kappa$ and $J_\kappa$ or at least one of the $V_\lambda$ and $J_\lambda$ germline segments of the nucleic acid molecule encoding the variable light chain of the first antibody is identical to one of the $V_\kappa$ and $J_\kappa$ or $V_\lambda$ and $J_\lambda$ germline segments of the nucleic acid molecule encoding the variable light chain of the related antibody.

26. A method according to claim 1, wherein the target antigen is selected from the group consisting of a polypeptide, carbohydrate, lipid, nucleic acid, and a small molecule.

27. A method according to claim 1, wherein the target antigen is expressed on the surface of a virus, bacteria, tumor or other cell, or is a recombinant protein or peptide.

28. A method according to claim 1, wherein the target antigen is a protein that is a target for therapeutic intervention, optionally selected from the group consisting of VEGFR-1, VEGFR-2, VEGFR-3 (vascular endothelial growth factor receptors 1, 2, and 3), a epidermal growth factor receptor (EGFR), ErbB-2, ErbB-3, IGF-R1, C-Met (also known as hepatocyte growth factor receptor; HGFR), DLL4, DDR1 (discoidin domain receptor), KIT (receptor for c-kit), FGFR1, FGFR2, FGFR4 (fibroblast growth factor receptors 1, 2, and 4), RON (recepteur d'origine nantais; also known as macrophage stimulating 1 receptor), TEK (endothelial-specific receptor tyrosine kinase), TIE (tyrosine kinase with immunoglobulin and epidermal growth factor homology domains receptor), CSF1 R (colony stimulating factor 1 receptor), PDGFRB (platelet-derived growth factor receptor B), EPHA1, EPHA2, EPHB1 (erythropoietin-producing hepatocellular receptor A1, A2 and B1), TNF-R1, TNF-R2, HVEM, LT-βR, CD20, CD3, CD25, NOTCH, G-CSF-R, GM-CSF-R, EPOR, a cadherin, an integrin, CD52, CD44, VEGF-A, VEGF-B, VEGF-C, VEGF-D, PIGF, EGF, HGF, TNF-α, LIGHT, BTLA, lymphotoxin (LT), lgE, G-CSF, GM-CSF and EPO.

29. A method according to claim 1, wherein the target antigen is involved in cell proliferation and differentiation, cell migration, apoptosis or angiogenesis.

30. A method according to claim 1, wherein a subset of the amino acid residues in the target region are modified by amino acid replacement.

31. A method according to claim 1, wherein only the amino acid residues that differ between the first antibody and related antibody in the target region are modified by amino acid replacement.

32. A method according to claim 1, wherein only the amino acid residues that are the same between the first antibody and the related antibody in the target region are modified by amino acid replacement.

33. A method according to claim 1, wherein all of the amino acids residues in the target region are modified by amino acid replacement.

34. A method according to claim 1, wherein each amino acid residue that is modified in the target region is modified to all 19 other amino acid residues, or a restricted subset thereof.

35. A method according to claim 1, further comprising determining the amino acid modifications that are altered in the modified antibody compared to the first antibody not containing the amino acid replacements.

36. A method according to claim 1, wherein the method is repeated iteratively, and wherein a modified antibody is selected and used in step a) as the first antibody for subsequent affinity maturation thereof.

37. A method according to claim 1, wherein one or more amino acid replacements in the target region of one or more variable heavy chains or one or more variable light chains of selected modified antibodies are combined to generate a further modified antibody, whereby the further modified antibody(ies) are screened for an affinity to the target antigen to identify a further modified antibody that exhibits an increased affinity for the target antigen compared to the first antibody and to the selected modified antibody(ies).

38. A method according to claim 1, wherein the antibody comprising a variable heavy chain and a variable light chain is selected from the group consisting of a Fab, Fab', F(ab')2, single-chain Fv (scFv), scFab, Fv, dsFv, diabody, Fd, Fd', Fab fragment, Fd fragment, Fd' fragment, scFv fragment, and scFab fragment.

* * * * *